(12) United States Patent
Schepartz Shrader et al.

(10) Patent No.: US 8,008,262 B2
(45) Date of Patent: Aug. 30, 2011

(54) β-PEPTIDES

(75) Inventors: Alanna Schepartz Shrader, Wilton, CT (US); Scott A. Hart, San Diego, CA (US); Joshua A. Kritzer, New Haven, CT (US); Olen M. Stephens, New Haven, CT (US)

(73) Assignee: Yale University, New Haven, CT (US)

(*) Notice: Subject to any disclaimer, the term of this patent is extended or adjusted under 35 U.S.C. 154(b) by 744 days.

(21) Appl. No.: 11/111,218

(22) Filed: Apr. 21, 2005

(65) Prior Publication Data
US 2005/0277592 A1 Dec. 15, 2005

Related U.S. Application Data

(60) Provisional application No. 60/564,455, filed on Apr. 21, 2004.

(51) Int. Cl.
*A61K 38/08* (2006.01)
*C08G 73/14* (2006.01)
*C12P 13/04* (2006.01)

(52) U.S. Cl. .................... 514/21.6; 525/54.11; 435/106; 436/90

(58) Field of Classification Search .................. None
See application file for complete search history.

(56) References Cited

FOREIGN PATENT DOCUMENTS
WO    WO 97/47593    12/1997

OTHER PUBLICATIONS

Arvidsson, 2001, Chem. Commun., 649-650.*
Hart, 2003, Journal of American Chemical Society, 125, 4022-4023.*
Neuman de Vegvar, 2003, Journal of Virology, 77, 11125-11138.*
Seebach, et al. "Biological and Pharmacokinetic Studies with β-Peptides," *Chimia 5.*, (1998), pp. 734-739, Neue Schweizerische Chemische Gsellschaft.
Seebach, et al. "β-Peptides: Synthesis by Arndt-Eistert Homologation with Concomitant Peptide Coupling. Structure Determination by NMR and CD Spectroscopy and by X-Ray Crystallography. Helical Secondary Structure of a β-Hexapeptide in Solution and Its Stability towards Pepsin," *Helvetica Chimica Acta.* vol. 79, (1996), pp. 913-941.
Frackenpohl, et al. "The Outstanding Biological Stability of β- and γ-Peptides toward Proteolytic Enzymes: an In Vitro Investigation with Fifteen peptidases," *Chembiochem*, 2001, 2, 445-455, Wiley-VCH-Verlag GmbH, D-69451 Weinheim, 2001.
Arvidsson, Per, et al., "Design, Machine Synthesis, and NMR-solution Structure of a β-Heptapeptide Forming a Salt-Bridge Stabilized $3_{14}$-Helix in Methanol and in Water," Chemical Communications, pp. 649-650, 2001.
Cheng, Richard P. et al., "De Novo Design of a Monomeric Helical β-Peptide Stabilized by Electrostatic Interactions," Journal of the American Chemical Society, 123(21), pp. 5162-5163, 2001.
Gademann, Karl et al., "Peptide Folding Induces High and Selective Affinity of a Linear and Small β-Peptide to the Human Somatostatin Receptor 4," Journal of Medicinal Chemistry, 44(15), pp. 2460-2468, 2001.
Gellman et al., "Foldamers: A Manifesto," Accounts of Chemical Research, vol. 31, No. 4, 1998, pp. 173-180.
Hart, Scott A., et al., "Helix Macrodipole Control of $β^3$-Peptide 14-Helix Stability in Water," Journal of the American Chemical Society, 125(14), pp. 4022-4023, 2003.
Kritzer, Joshua A., et al., "Helical β-Peptide Inhibitors of the p53-hDM2 Interaction," Journal of the American Chemical Society, 126(31), pp. 9468-9469, 2004.
Kritzer, Joshua A., et al., "Relationship between Side Chain Structure and 14-Helix Stability of $8^3$-Peptides in Water," Journal of the American Chemical Society, 127(1), pp. 167-178, 2005.
Kritzer, Joshua A., et al., "Solution Structure of a β-Peptide Ligand for hDM2," Journal of the American Chemical Society, 127, pp. 4118-4119, 2005.
Kritzer, Joshua A., et al., "β-Peptides as Inhibitors of Protein-Protein Interactions," Bioorganic & Medicinal Chemistry, 13(()), pp. 11-16, 2004.
Murray, Justin K., et al., "Application of Microwave Irradiation to the Synthesis of 14-Helical β-Peptides," Organic Letters, vol. 7, No. 8, pp. 1517-1520, 2005.
Raguse, Tami L., et al., Environment-Independent 14-Helix Formation in Short β-Peptides: Striking a Balance between Shape Control and Functional Diversity, Journal of the American Chemical Society, 125(19), pp. 5592-5593, 2003.
Search Report mailed Sep. 15, 2006 in PCT/US2005/013570 (filed Apr. 21, 2005).

* cited by examiner

*Primary Examiner* — Cecilia Tsang
*Assistant Examiner* — Satyanarayana Gudibande
(74) *Attorney, Agent, or Firm* — Wolf, Greenfield & Sacks, P.C.

(57) ABSTRACT

β-peptide regions of polypeptides can serve as structural mimics of α-helices in wild type proteins. Because α-helices of one protein often bind to a target protein in a biological pathway, a polypeptide that contains a helical β-peptide region can be used to disrupt this type of protein-protein binding. As a result, polypeptides that contain a helical β-peptide region can be used to treat conditions involving this type of protein-protein binding, such as viral infections and cell proliferation.

4 Claims, 12 Drawing Sheets

β-PEPTIDES

CROSS REFERENCE TO RELATED APPLICATIONS

This application claims the benefit of U.S. Provisional Application No. 60/564,455, filed Apr. 21, 2004. The teachings of the referenced application are incorporated herein by reference in their entirety.

This application contains a Sequence Listing which has been submitted by CD in lieu of a printed paper copy, and is hereby incorporated by reference in its entirety. Said CDs, recorded on Aug. 13, 2007, are labeled "Copy 1" and "Copy 2" respectively, and each contains one identical 849 kb file (entitled "Sequence Listing").

FUNDING

Work described herein was funded, in whole or in part, by National Institutes of Health grants GM59843 and GM65453. The United States government has certain rights in the invention.

BACKGROUND OF THE INVENTION

Many proteins recognize nucleic acids, other proteins or macromolecular assemblies using a partially exposed alpha helix. Within the context of a native protein fold, such alpha helices are usually stabilized by extensive tertiary interactions with residues that may be distant in primary sequence from both the alpha helix and from each other. With notable exceptions (Armstrong et al., (1993) J. Mol. Biol. 230, 284-291), removal of these tertiary interactions destabilizes the alpha helix and results in molecules that neither fold nor function in macromolecular recognition (Zondlo & Schepartz, (1999) J. Am. Chem. Soc. 121, 6938-6939). The ability to recapitulate or perhaps even improve on the recognition properties of an alpha helix within the context of a small molecule should find utility in the design of synthetic mimetics or inhibitors of protein function (Cunningham et al., (1997) Curr. Opin. Struct. Biol. 7, 457-462) or new tools for proteomics research.

Two fundamentally different approaches have been taken to bestow alpha helical structure on otherwise unstructured peptide sequences. One approach makes use of modified amino acids or surrogates that favor helix initiation (Kemp et al., (1991) J. Org. Chem. 56, 6683-6697) or helix propagation (Andrews & Tabor, (1999) Tetrahedron 55, 11711-11743; Blackwell & Grubbs, (1998) Angew. Chem. Int. Ed. Eng. 37, 3281-3284; Schafmeister et al., (2000) J. Am. Chem. Soc. 122, 5891-5892). Perhaps the greatest success has been realized by joining the i and i+7 positions of a peptide with a long-range disulfide bond to generate molecules whose helical structure was retained at higher temperatures (Jackson et al., (1991) J. Am. Chem. Soc. 113, 9391-9392). A second approach (Cunningham et al., (1997) Curr. Opin. Struct. Biol. 7, 457-462; Nygren, (1997) Curr. Opin. Struct. Biol. 7, 463-469), is to pare the extensive tertiary structure surrounding a given recognition sequence to generate the smallest possible molecule possessing function. This strategy has generated minimized versions of the Z domain of protein A (fifty-nine amino acids) and atrial natriuretic peptide (twenty-eight amino acids). The two minimized proteins, at thirty-three and fifteen amino acids, respectively, displayed high biological activity (Braisted & Wells, (1996) Proc. Natl. Acad. Sci., USA 93, 5688-5692; Li et al., (1995) Science 270, 1657-1660). Despite this success, it is difficult to envision a simple and general application of this truncation strategy in the large number of cases where the alpha helical epitope is stabilized by residues scattered throughout the primary sequence.

Another approach to generate a structure analogous to an alpha helix involves the use of β-peptides to form helical structures. Depending upon the amino acid content of such β-peptides and the ambient conditions, they can form various types of helical or sheet-like structures. In most cases, these β-peptides assemble into helices only in non-aqueous solvents such as methanol and do not form stable helices under aqueous conditions. The Those β-peptides that do form stable helices under aqueous conditions rely on the presence of side chains capable of forming salt bridges on two of three helical faces (approximately two thirds of all possible sequence positions), thereby limiting which β-amino acids can be present. For this reason, there is a need for β-peptides that form helices under aqueous conditions and that allow for greater variation in the component amino acids. There is also a need to find β-peptides that can interact with regions of proteins that typically bind to an alpha helix, especially with specificity.

SUMMARY OF THE INVENTION

It has now been discovered that β-peptides (beta-peptides) having helical regions in aqueous conditions can be prepared where no more than one third of the amino acid residues are capable of forming salt bridges, and that such β-peptides function as mimetics of wild type proteins. For example, Example 1 shows that a multitude of β-peptides have significant 14 helical structure when dissolved in aqueous buffer. Example 2 further shows that β-peptides serve as mimics for certain α-helices (alpha-helices) in wild type proteins, because they are able to bind to the same locations on target proteins as the α-helices.

In one embodiment, the invention is a polypeptide with a β-peptide region, where the β-peptide region includes a sufficiently helical structured region in aqueous solution to be capable of binding to a portion of a target protein that binds to an a helix of a second protein, the sufficiently helical structured region of the β-peptide region includes amino acid residues capable of forming (that form) salt bridges at no more than one third of positions in the sufficiently helical structured region and where at least two β-amino acid residues have side chains that interact directly with the target protein.

In another embodiment, the invention is a β-peptide, wherein the β-peptide includes a sufficiently helical structured region in aqueous solution to be capable of binding to a portion of a target protein that binds to an α helix of a second protein and where the sufficiently helical structured region includes amino acid residues capable of forming salt bridges at no more than one third of positions in the sufficiently helical structured region, and at least two amino acid residues have side chains that interact directly with the target protein.

In a yet another embodiment, the invention is a β-peptide, where the β-peptide is capable of forming a 14-helix in aqueous solution; the 14-helix includes only one series of salt bridges and at least two amino acid residues have side chains that interact directly with a target protein.

In a further embodiment, the invention is a compound represented by Structural Formula (I):

$$H_2N\text{-}A\text{-}B\text{---}(C\text{-}D\text{-}E\text{-}F\text{-}G\text{-}H)_x\text{---}I\text{-}J\text{-}K\text{-}L\text{-}M\text{-}COO^- \qquad (I),$$

or a pharmaceutically acceptable salt thereof, where:

A and B are absent or are independently $\beta^3$-amino acids;
each C is independently a $\beta^3$-amino acid having a positively charged side chain at pH 7;

each D and E is independently a $\beta^3$-amino acid;

each F is independently a $\beta^3$-amino acid having a negatively charged side chain at pH 7;

each G and H independently a $\beta^3$-amino acid;

I is a $\beta^3$-amino acid having a positively charged side chain at pH 7, or I is absent when L is absent;

J and K are independently $\beta^3$-amino acids, or J and K are absent when I is absent;

L is a $\beta^3$-amino acid having a negatively charged side chain at pH 7, or L is absent;

M is absent or a $\beta^3$-amino acid; and x is a positive integer, where at least two of A-M have side chains that interact directly with a target protein.

The present invention also includes pharmaceutical compositions comprising the compounds disclosed herein, where the pharmaceutical composition includes a pharmaceutically acceptable carrier and a compound of the invention.

In one embodiment, compounds (polypeptides) of the invention include at least one amino acid residue other than $\beta^3$-Orn and $\beta^3$-Glu in the series of salt bridges.

The invention further includes the use of the compounds disclosed herein in medicine, such as for treating a disease or condition disclosed herein. In addition, the invention includes the use of the compounds disclosed herein in the manufacture of a medicament for treating a disease or condition disclosed herein.

In one embodiment, the present invention is a method of inhibiting interaction between a first protein and a second protein with a compound of the invention. Such inhibition can occur either in vitro (e.g., where the proteins, or the cells containing the proteins, are contacted with a compound of the invention) or in vivo (e.g., where a compound of the invention is administered to a subject in need of inhibiting interaction between the proteins).

In another embodiment, the present invention is a method of inhibiting proliferation of tumor cells by contacting the tumor cells with a compound of the invention or by administering a compound of the invention to a subject in need of inhibiting proliferation of tumor cells. Such a method can be employed in the treatment of cancer or another hyperproliferative condition or disease.

In yet another embodiment, the present invention is a method of inhibiting infection of a cell by a virus by contacting the cell with a compound of the invention or by administering a compound of the invention to a subject in need of treatment (including therapeutic and prophylactic treatment) of a viral infection.

The present invention provides polypeptides that are $\beta$-peptides or include a $\beta$-peptide region, which can be prepared with a wide variety of amino acid residues that retain a helical structure in aqueous solution, such as Compounds 1-1065 (SEQ ID NOS: 4-1068) described in the Examples. These polypeptides are useful in disrupting protein-ligand interactions, particularly protein-protein interactions. Because of the flexibility in preparing the polypeptides, the polypeptides can be designed to disrupt numerous interactions, such as those involved in the proliferation of cells (e.g., unwanted proliferation of cells) or in infection of cells.

DETAILED DESCRIPTION

Definitions

Figure 1:
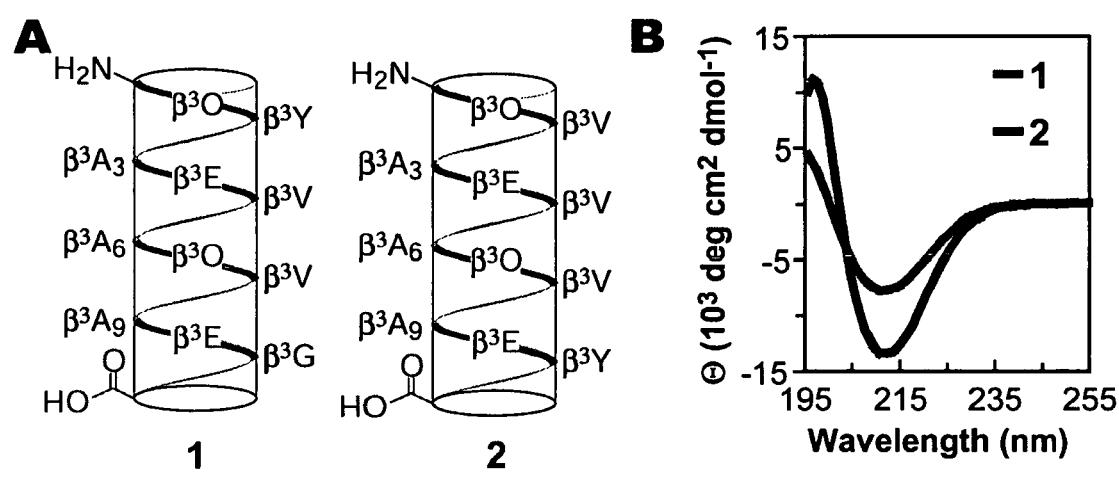
FIG. 1 shows (A) helical net diagrams of $\beta$-peptides 1 and 2, where $\beta^3X$ refers to a $\beta^3$-amino acid with side chain analogous to the $\alpha$-amino acid with the common one-letter code X, and (B) circular dichroism spectra of $\beta$-peptides 1 (red) and 2 (black) at 100 μM and 80 μM, respectively, in PBC (1 mM sodium phosphate/borate/citrate, pH 7.0) at 25° C.

As used herein, the term "binding" refers to the association or other interaction (e.g., specific association or specific interaction) between two molecular species, such as, but not limited to, protein-DNA interactions and protein-protein interactions. The association can be, for example, between proteins and their DNA targets, receptors and their ligands, enzymes and their substrates. It is contemplated that such association is mediated through specific sites on each of the two interacting molecular species, such that one molecule is interacting directly with the other. Binding is mediated by structural and/or energetic components, the latter comprising the interaction of molecules with opposite charges.

As used herein, the term "binding site" refers to the reactive region or domain of a macromolecule that directly participates in its binding with another molecule. For example, when referring to the binding site on a protein or nucleic acid, binding occurs as a result of the presence of specific amino acids or nucleic acids, respectively, that interact with the other molecule and, collectively, are referred to as a "binding site."

As used herein, the term "modulate" refers to an alteration in the association between two molecular species, for example, alteration of the effectiveness of a biological agent to interact with its target by altering the characteristics of the interaction in a competitive or non-competitive manner.

As used herein, the term "salt bridge" refers to a stabilizing interaction formed by oppositely-charged molecules. With respect to polypeptides, a salt bridge is formed between two amino acid residues having opposite charges.

The present invention provides polypeptides that are β-peptides or include a β-peptide region that retain a helical structure in aqueous solution, and can be prepared with a wide variety of amino acid residues, but retain a helical structure in aqueous solution. Typically, the β-peptides or β-peptide regions of the invention consist of $\beta^3$-amino acid residues, more typically, $\beta^3$-L-amino acid residues. When amino acid sequences are shown herein, the residues progress from C-terminal to N-terminal when read from left to right.

In one embodiment, the β-peptide region of polypeptides of the invention (particularly the helical region thereof) includes the following sequence:

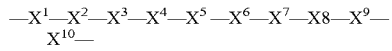

where $X^1$ and $X^7$ are independently β-amino acid residues having a positively charged side chain and $X^4$ and $X^{10}$ are independently β-amino acid residues having a negatively charged side chain; and
$X^2$, $X^3$, $X^5$, $X^6$, $X^8$ and $X^9$ are each independently a β-amino acid residue.

Typical values of $X^1$ and $X^7$ include $\beta^3$-Lys, $\beta^3$-Orn and $\beta^3$-aminomethylalanine.

Typical values of $X^4$ and $X^{10}$ include $\beta^3$-Asp and $\beta^3$-Glu. In one embodiment, when both $X^1$ and $X^7$ are $\beta^3$-Orn at least one of $X^4$ and $X^{10}$ is not $\beta^3$-Glu.

In a particular embodiment, two of $X^2$, $X^3$, $X^5$, $X^6$, $X^8$ and $X^9$ are β-amino acid residues having side chains that interact directly with the target protein.

In another particular embodiment, at least one of $X^2$, $X^3$, $X^5$, $X^6$, $X^8$ and $X^9$ is a β-amino acid residue having a side chain that includes an α-carbon, where the α-carbon is a secondary carbon. Typical examples of such amino acid residues are $\beta^3$-Ile, $\beta^3$-Val and $\beta^3$-Thr.

In yet another particular embodiment, at least two of $X^2$, $X^5$ and $X^8$ or at least two of $X^3$, $X^6$ and $X^9$ are independently β-amino acid residues having a side chain capable of forming hydrogen bonds. Typical examples of such amino acid residues are $\beta^3$-Ser and $\beta^3$-Thr.

In a further particular embodiment, at least one of $X^2$, $X^3$, $X^5$, $X^6$, $X^8$ and $X^9$ is a β-amino acid residue where the amino and carbonyl groups of the amino acid residue are pendant from a 6-membered ring. Typically, the amino acid residue is trans-2-aminocyclohexanecarboxylic acid.

When the polypeptide includes amino acid residues (e.g., α-amino acid residues) in addition to the β-amino acid residues, the α-amino acid residues can be selected to confer additional properties to the polypeptide. In one example, the α-amino acid residues comprise a region used to aid in targeting the polypeptide to a particular organ, tissue, cell, protein or other ligand. In another example, the α-amino acid residues are used to enhance uptake of the polypeptide by cells. Suitable α-amino acid regions for enhancing uptake by cells include protein transduction domains such as octa-α-(L)-arginine and a Tat-derived region sequence.

Typically, the polypeptides of the invention consist of β-amino acid residues. Such polypeptides consisting of β-amino acid residues (e.g., lacking α-amino acid residues) are referred to herein as β-peptides. The β-peptides can contain one or a combination of β-amino acid residues having naturally occurring or non-naturally occurring sidechains (e.g., the sidechain of arginine, tryptophan, etc.). β-amino acid residues having naturally occurring sidechains are referred to using the name of the corresponding naturally occurring amino acid residue. For example, the $\beta^3$-amino acid residue having the same sidechain as asparatic acid is referred to as $\beta^3$-aspartic acid or $\beta^3$-Asp. The stereochemical configuration for these $\beta^3$-amino acids at the chiral backbone carbon is generally (S).

In one embodiment, compounds represented by Structural Formula (I):

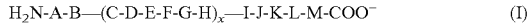

have each C independently selected from the group consisting of $\beta^3$-Lys, $\beta^3$-Orn, $\beta^3$-Arg and $\beta^3$-aminomethylalanine.

In another embodiment, each F is independently selected from the group consisting of $\beta^3$-Glu and $\beta^3$-Asp. In a particular embodiment, each C is independently selected from the group consisting of $\beta^3$-Lys, $\beta^3$-Orn, $\beta^3$-Arg and $\beta^3$-aminomethylalanine and each F is independently selected from the group consisting of $\beta^3$-Glu and $\beta^3$-Asp. In another particular embodiment, when each F is $\beta^3$-Glu, at least one C is not $\beta^3$-Orn For compounds of Structural Formula (I), at least one occurrence of D, E, G and H is advantageously a β-amino acid residue having a side chain that includes an α-carbon, where the α-carbon is a secondary carbon. Examples of such amino acid residues include $\beta^3$-Ile, $\beta^3$-Val and $\beta^3$-Thr.

In one embodiment, D and G or E and H in at least one repeat unit or in adjacent repeat units are independently β-amino acid residues having a side chain capable of forming hydrogen bonds, for example, $\beta^3$-Ser and $\beta^3$-Thr.

In another embodiment, at least one occurrence of D, E, G and H is a β-amino acid residue where the amino and carboxylate groups are pendant from a 6-membered ring, particularly trans-2-aminocyclohexanecarboxylic acid.

Typically, x is an integer from 1 to 5, more typically, x is 1 or 2.

Typically, in each of the embodiments for compounds represented by Structural Formula (I), at least one occurrence of D, E, G and H is a β-amino acid residue having a side chain that interacts directly with a target protein. More typically, at least two of D, E, G and H are β-amino acid residues having side chains that interact directly with a target protein. In a preferred embodiment, at least one occurrence of D and G or at least one occurrence of E and H are β-amino acid residues having side chains that interact directly with a target protein. More typically, D, E, G and H are selected such that: 1) when each D is a positively charged β-amino acid residue, at least one G is a neutral or positively charged β-amino acid residue; 2) when each D is a negatively charged β-amino acid residue, at least one G is a neutral or negatively charged β-amino acid residue; 3) when each E is a positively charged β-amino acid residue, at least one H is a neutral or positively charged β-amino acid residue; 4) when each E is a negatively charged β-amino acid residue, at least one H is a neutral or negatively charged β-amino acid residue; 5) when each G is a positively charged β-amino acid residue, at least one D is a neutral or positively charged β-amino acid residue; 6) when each G is a negatively charged β-amino acid residue, at least one D is a neutral or negatively charged β-amino acid residue; 7) when each H is a positively charged β-amino acid residue, at least one E is a neutral or positively charged β-amino acid residue; and 8) when each H is a negatively charged β-amino acid residue, at least one E is a neutral or negatively charged β-amino acid residue.

When at least one occurrence of D, E, G and H interacts directly with a protein, the remainder of these values generally have the values set forth above (e.g., one or more have a side chain that includes an α-carbon where the α-carbon is a secondary carbon, have a side chain capable of forming hydrogen bonds, and/or are trans-2-aminocyclohexanecarboxylic acid). Those D, E, G and H that interact directly with a protein are typically amino acid residues with hydrophobic alkyl or aromatic sidechains (e.g., $\beta^3$-Phe, $\beta^3$-Trp, $\beta^3$-Ile, $\beta^3$-Leu, etc.). The sidechains can also be non-naturally occurring.

Protein-Binding Beta-Peptides

The invention encompasses polypeptides that bind to proteins and methods for making these polypeptides. The binding of the polypeptides modulates protein-protein and/or protein-ligand interactions. Thus, in some embodiments, the binding blocks the association (or specific binding) of ligands and receptors. The ligand can be either another protein but also can be any other type of molecule such as a chemical substrate. In one embodiment of the present invention, making the protein-binding polypeptides of the invention involves identifying the amino acid residues which are essential to binding of the ligand protein to its target receptor protein. In some embodiments, these essential residues are identified using three-dimensional models of a protein or protein complex which binds to or interacts with another protein based on crystallographic studies, while in other embodiments they are identified by studies of deletion or substitution mutants of the protein. The residues that participate in binding of the protein are then included at corresponding positions of the polypeptide, provided that they are not necessary to maintain the structure of the polypeptide (e.g., residues not involved in formation of a salt bridge).

The structure of any protein which binds to another protein can be used to design the protein-binding polypeptides of the invention. Examples include helical structures such as those involved in protein-protein interactions between Fos and Jun (Kouzarides & Ziff, (1988) Nature 336, 646-651); Bcl-2 and Bak (Sattler et al., (1997) Science 275, 983-986); CBP-KIX and CREB-KID (Radhakrishnan et al., (1997) Cell 91, 741-752); p53 and MDM2 (hDM2) (Kussie et al., (1996) Science 274, 948-953); and a protein kinase and a protein kinase inhibitor (PKI) (Glass et al., (1989) J Biol Chem 264, 14579-84). In some embodiments, the binding involves coiled coil protein structures and/or leucine zippers.

In certain embodiments, polypeptides of the invention include fragments, functional variants, and modified forms that have similar or the same biological activities as those of their corresponding wild-type proteins. To illustrate, polypeptides of the invention bind to a target protein and modulate (e.g., activate or inhibit) a function of the target protein. In certain cases, target proteins of the polypeptides are known to play a role in cell proliferation and differentiation. Therefore, polypeptides of the invention can be used for treating (therapeutically or prophylactically) disorders associated with abnormal cell proliferation and differentiation (e.g., inflammation, allergy, autoimmune diseases, infectious diseases, and tumors). In certain cases, target proteins of the polypeptides are known to play a role in a virus gaining entry into a cell (e.g., a mammalian cell). Therefore, polypeptides of the invention can be used for treating (prophylactically or therapeutically) viral diseases, particularly those where a target protein on the surface of the virus must bind to a protein on a cell surface prior to infecting the cell. Examples of diseases that can be treated by the compounds disclosed herein include HIV/AIDS, influenza, respiratory syncytial virus, SARS, Ebola, herpes, hepatitis B, measles, vesicular stomatitis and T-cell leukemia.

In certain embodiments, polypeptides of the present invention further include conservative variants of the polypeptides herein described. As used herein, a conservative variant refers to a polypeptide comprising alterations in the amino acid sequence that do not substantially and adversely affect the binding or association capacity of the polypeptide. A substitution, insertion or deletion is said to adversely affect the polypeptide when the altered sequence prevents or disrupts a function or activity associated with the polypeptide.

In certain embodiments, these variants, though possessing a slightly different amino acid sequence than those recited above, will still have the same or similar properties associated with the polypeptides such as those depicted in Compounds 1-1065(SEQ ID NOS: 4-1068).

In some embodiments, the conservative substitution variants, will have an amino acid sequence having at least ninety percent amino acid sequence identity with the polypeptide sequences such as those set forth in Compound 1-1065(SEQ ID NOS: 4-1068), such as at least ninety-five percent, for example, at least ninety-eight percent or at least ninety-nine percent. Percent identity or homology with respect to such sequences is defined herein as the percentage of amino acid residues in the candidate sequence that are identical with the known peptides, after aligning the sequences and introducing gaps, if necessary, to achieve the maximum percent homology, and not considering any conservative substitutions as part of the sequence identity. N-terminal, C-terminal or internal extensions, deletions, or insertions into the peptide sequence shall not be construed as affecting homology.

In one embodiment, compounds of the invention bind to hDM2, such as preferentially bind to hDM2. Preferential binding is defined herein to mean that a compound of the invention has the greatest affinity for the recited target protein, such as a 10-fold or greater, 100-fold or greater or 1000-fold or greater affinity for the target protein, than for another protein. While Applicants do not wish to be bound by theory, the binding to hDM2 is believed to inhibit the interaction between p53 and hDM2.

In another embodiment, compounds of the invention bind to either Myc or Max, such that interaction between these proteins is inhibited.

In yet another embodiment, compounds of the invention bind to viral envelope proteins, which are associated with human immunodeficiency viruses (HIV), influenza viruses, respiratory syncytial viruses, coronaviruses (e.g., the coronavirus associated with severe acute respiratory syndrome (SARS)), Ebola viruses, herpes viruses, hepatitis B viruses, measles viruses, vesicular stomatitis viruses and T-cell leukemia viruses. An exemplary protein is gp41 from HIV. Preferred compounds of the invention bind, particularly preferentially bind, to gp41. This binding can, for example, inhibit interaction between two or more gp41 proteins.

Thus, the polypeptides of the present invention include molecules comprising the amino acid sequence of Compounds 1-1065(SEQ ID NOS: 4-1068); functional fragments thereof; amino acid sequence variants of such sequences wherein at least one (α- or β-) amino acid residue has been inserted N- or C-terminal to the disclosed sequence; β-amino acid sequence variants of the disclosed sequences, or their fragments as defined above, that have been substituted by another residue. Contemplated variants further include those derivatives wherein the protein has been covalently modified by substitution, chemical, enzymatic, or other appropriate means with a sidechain moiety other than that of a naturally occurring amino acid (for example, a detectable moiety such as an enzyme or radioisotope).

Synthesis and Characterization of Compounds

In certain embodiments, the polypeptides of the present invention can be chemically synthesized using techniques known in the art, such as conventional Merrifield solid phase f-Moc or t-Boc chemistry (see Example 1). Alternatively, the polypeptides can be produced by other chemical syntheses, such as automated techniques.

In certain embodiments, the polypeptides of the invention may further comprise modifications analogous to post-translational modifications. Such modifications include, but are not limited to, acetylation, carboxylation, glycosylation, phosphorylation, lipidation, and acylation. As a result, the modified polypeptides may contain non-amino acid elements, such as polyethylene glycols, lipids, poly- or monosaccharide, and phosphates. Effects of such non-amino acid elements on the functionality of a polypeptide may be tested by methods such as those described in the working examples.

In certain aspects, functional variants or modified forms of the polypeptides include fusion proteins having at least a portion of a polypeptide and one or more fusion domains. Well known examples of such fusion domains include, but are not limited to, polyhistidine, Glu-Glu, glutathione S transferase (GST), thioredoxin, protein A, protein G, an immunoglobulin heavy chain constant region (Fc), maltose binding protein (MBP), or human serum albumin. A fusion domain may be selected so as to confer a desired property. For example, some fusion domains are particularly useful for isolation of the fusion proteins by affinity chromatography. For the purpose of affinity purification, relevant matrices for affinity chromatography, such as glutathione-, amylase-, and nickel- or cobalt-conjugated resins are used. Many of such matrices are available in "kit" form, such as the Pharmacia GST purification system and the QIAexpress™ system (Qiagen) useful with ($HIS_6$) fusion partners. As another example, a fusion domain may be selected so as to facilitate detection of the polypeptides. Examples of such detection domains include the various fluorescent proteins (e.g., GFP) as well as "epitope tags," which are usually short peptide sequences for which a specific antibody is available. Well known epitope tags for which specific monoclonal antibodies are readily available include FLAG, influenza virus haemagglutinin (HA), and c-myc tags. In some cases, the fusion domains have a protease cleavage site, such as for Factor Xa or Thrombin, which allows the relevant protease to partially digest the fusion proteins and thereby liberate the polypeptides therefrom. The liberated polypeptides can then be isolated from the fusion domain by subsequent chromatographic separation. In certain embodiments, a polypeptide is fused with a domain that stabilizes the polypeptide in vivo (a "stabilizer" domain). A "stabilizer" domain increases serum half life, regardless of whether this is because of decreased destruction, decreased clearance by the kidney, or other pharmacokinetic effect. Fusions with the Fc portion of an immunoglobulin are known to confer desirable pharmacokinetic properties on a wide range of proteins. Likewise, fusions to human serum albumin can confer desirable properties.

The degree of 14 helical character of compounds of the invention can be assessed using a variety of biophysical methods. A 14 helical structure is characterized by a hydrogen bond between an amide proton at residue (i) and a backbone carbonyl at residue (i+2), such that side chain three residues apart all appear on the same face of the helix. A compound having significant 14 helical structure is identified by a circular dichroism (CD) spectrum exhibiting ellipticity minima at 211-215 nm, ellipticity maxima at 195-198 mn and zero ellipticity at 200-202 nm. The percentage of 14 helical structure is determined based upon the mean residue ellipticity at 211-215 nm. Typically, compounds of the invention have at least 40%, at least 50%, at least 60% or at least 70% helical structure as measured CD spectroscopy. Alternatively, the presence of 14 helical structure can be measured using NMR techniques, typically 2-dimensional NMR techniques (COSY, TOCSY, NOESY, ROESY). These NMR techniques investigate, for example, through space correlations and through bond correlations between protons. In the case of a 14 helix, through space correlations are expected between CαH(i) and CβH(i+3) and between $C_N$H(i) and CβH(i+3). It may not be possible to see all such correlations in an NMR spectrum due to resonance overlap. Generally, 14 helical structure exists where through space correlations are observed and no resonances inconsistent with 14 helical structure are observed.

Methods to Identify Binding Partners

The present invention provides methods for use in isolating and identifying binding partners of the polypeptides of the invention. In some embodiments, a polypeptide of the invention is mixed with a potential binding partner or an extract or fraction of a cell under conditions that allow the association of potential binding partners with the polypeptide of the invention. After mixing, peptides, polypeptides, proteins or other molecules that have become associated with a polypeptide of the invention are separated from the mixture. The binding partner bound to the polypeptide of the invention can then be removed and further analyzed. To identify and isolate a binding partner, the entire polypeptide can be used. Alternatively, a fragment of the polypeptide which contains the binding domain can be used.

As used herein, a "cellular extract" refers to a preparation or fraction which is made from a lysed or disrupted cell. A variety of methods can be used to obtain an extract of a cell. Cells can be disrupted using either physical or chemical disruption methods. Examples of physical disruption methods include, but are not limited to, sonication and mechanical shearing. Examples of chemical lysis methods include, but are not limited to, detergent lysis and enzyme lysis. A skilled artisan can readily adapt methods for preparing cellular extracts in order to obtain extracts for use in the present methods.

Once an extract of a cell is prepared, the extract is mixed with a polypeptide of the invention under conditions in which association of the polypeptide with the binding partner can occur. A variety of conditions can be used, but are typically conditions that closely resemble conditions found in the cytoplasm of a human cell. Features such as osmolarity, pH, temperature, and the concentration of cellular extract used, can be varied to optimize the association of the polypeptide with the binding partner.

After mixing under appropriate conditions, the bound complex is separated from the mixture. A variety of techniques can be utilized to separate the mixture. For example, antibodies specific to a polypeptide of the invention can be used to immunoprecipitate the binding partner complex. Alternatively, standard chemical separation techniques such as chromatography and density-sediment centrifugation can be used.

After removal of non-associated cellular constituents found in the extract, the binding partner can be dissociated from the complex using conventional methods. For example, dissociation can be accomplished by altering the salt concentration or pH of the mixture or by altering the solvent (e.g., including a water-miscible organic solvent).

To aid in separating associated binding partner pairs from the mixed extract, the polypeptide of the invention can be immobilized on a solid support. For example, the polypeptide can be attached to a nitrocellulose matrix or acrylic beads. Attachment of the polypeptide to a solid support aids in separating peptide-binding partner pairs from other constituents found in the extract. The identified binding partners can be either a single DNA molecule or protein or a complex made up of two or more proteins. Alternatively, binding partners may be identified using the Alkaline Phosphatase fusion assay according to the procedures of Flanagan & Vanderhaeghen, (1998) Annu. Rev. Neurosci. 21, 309-345 or Takahashi et al., (1999) Cell 99, 59-69; the Far-Western assay according to the procedures of Takayama et al., (1997) Methods Mol. Biol. 69, 171-184 or Sauder et al., J. Gen. Virol. (1996) 77, 991-996 or identified through the use of epitope tagged proteins or GST fusion proteins.

Screening, Diagnostic & Therapeutic Uses

The polypeptides (including variants thereof) of the invention are particularly useful for drug screening to identify agents that bind to the same binding site as that bound by the polypeptides. The polypeptides of the invention are also useful for diagnostic purposes to identify the presence and/or detect the levels of DNA or protein that binds to the polypeptides of the invention. In one diagnostic embodiment, the polypeptides of the invention are included in a kit used to detect the presence of a particular DNA or protein in a biological sample. The polypeptides of the invention also have therapeutic uses in the treatment of diseases associated with the presence of a particular DNA or protein. In one therapeutic embodiment, the polypeptides can be used to bind to DNA to promote or inhibit transcription, while in another therapeutic embodiment, the polypeptides bind to a protein, resulting in inhibition or stimulation of the protein.

As described above, polypeptides bind to target proteins (gp41, Myc, hDM2, CBP, PKA, a Bcl2 protein, a Bcl-$X_L$ protein or variants of any of the foregoing) which, for example, are implicated in cell proliferation and differentiation and in a virus fusing to and infecting a cell. Thus, in certain embodiments, the present invention provides methods of treating cancer in an individual suffering from a disorder associated with abnormal cell proliferation and differentiation by administering to the individual a therapeutically effective amount of a polypeptide as described above. Examples of such disorders include, but are not limited to, inflammation, allergy, autoimmune diseases, infectious diseases, and tumors (cancers). In other certain embodiments, the present invention provides methods of treating a viral infection in a subject in need thereof by administering to the individual a therapeutically effective amount of a polypeptide as described above.

In other embodiments, the invention provides methods of preventing or reducing the onset of a disorder associated with abnormal cell proliferation and differentiation or viral infection in an individual through administering to the individual an effective amount of a polypeptide of the present invention. These methods are particularly aimed at therapeutic and prophylactic treatments of animals, and more particularly, humans. The term "inhibiting" is art-recognized, and when used in relation to a condition, such as cancer or a viral infection, is well understood in the art, and includes reducing the frequency of, or delaying the onset of symptoms of a medical condition (here, cancer), or reversing the symptoms in a subject relative to a subject who does not receive the composition. Thus, inhibition of cancer includes, for example, reducing the number of detectable cancerous growths in patients receiving a prophylactic treatment relative to an untreated patient, and/or delaying the appearance of detectable cancerous growths in a patient versus an untreated control, e.g., by a statistically and/or clinically significant amount. Inhibition of an infection includes, for example, reducing the number of diagnoses of the infection versus an untreated control, and/or delaying the onset of symptoms and reversing the symptoms of the infection in a treated patient versus an untreated control.

In certain embodiments of such methods, one or more polypeptides of the invention can be administered, together (simultaneously) or at different times (sequentially). In addition, a polypeptide can be administered with another type of compound for treating cancer (see below). The two types of compounds may be administered simultaneously or sequentially.

A wide array of conventional compounds has been shown to have anti-tumor activities. These compounds have been used as pharmaceutical agents in chemotherapy to shrink solid tumors, prevent metastases and further growth, or decrease the number of malignant cells. Although chemotherapy has been effective in treating various types of malignancies, many anti-tumor compounds induce undesirable side effects. In many cases, when two or more different treatments are combined, the treatments may work synergistically and allow reduction of dosage of each of the treatments, thereby reducing the detrimental side effects exerted by each compound at higher dosages. In other instances, malignancies that are refractory to a treatment may respond to a combination therapy of two or more different treatments.

Therefore, the subject polypeptides may be conjointly administered with a conventional anti-tumor compound. Conventional anti-tumor compounds include, merely to illustrate: aminoglutethimide, amsacrine, anastrozole, asparaginase, beg, bicalutamide, bleomycin, buserelin, busulfan, camptothecin, capecitabine, carboplatin, carmustine, chlorambucil, cisplatin, cladribine, clodronate, colchicine, cyclophosphamide, cyproterone, cytarabine, dacarbazine, dactinomycin, daunorubicin, dienestrol, diethylstilbestrol, docetaxel, doxorubicin, epirubicin, estradiol, estramustine, etoposide, exemestane, filgrastim, fludarabine, fludrocortisone, fluorouracil, fluoxymesterone, flutamide, gemcitabine, genistein, goserelin, hydroxyurea, idarubicin, ifosfamide, imatinib, interferon, irinotecan, ironotecan, letrozole, leucovorin, leuprolide, levamisole, lomustine, mechlorethamine, medroxyprogesterone, megestrol, melphalan, mercaptopurine, mesna, methotrexate, mitomycin, mitotane, mitoxantrone, nilutamide, nocodazole, octreotide, oxaliplatin, paclitaxel, pamidronate, pentostatin, plicamycin, porfimer, procarbazine, raltitrexed, rituximab, streptozocin, suramin, tamoxifen, temozolomide, teniposide, testosterone, thioguanine, thiotepa, titanocene dichloride, topotecan, trastuzumab, tretinoin, vinblastine, vincristine, vindesine, and vinorelbine.

In another related embodiment, the invention contemplates the practice of the method in conjunction with other anti-tumor therapies such as radiation. As used herein, the term "radiation" is intended to include any treatment of a neoplastic cell or subject by photons, neutrons, electrons, or other type of ionizing radiation. Such radiations include, but are not limited to, X-ray, gamma-radiation, or heavy ion particles, such as alpha or beta particles. Additionally, the radiation may be radioactive.

In certain embodiments, the present invention provides methods of treating viral infections in a subject. A number of viruses share similar protein/glycoprotein structures which have been implicated in the mechanism of viral fusion and entry into permissive cells. The present invention provides methods of screening for polypeptides that inhibit viral fusion and/or entry into permissive cells. For example, the screening methods may involve selectively triggering the formation of one or more critical entry intermediates in cell-surface-expressed viral envelope in the presence of a test polypeptide and probing for the formation or lack of formation of such intermediates. A specific embodiment of the invention is directed to a method for generating polypeptides which disrupt formation of gp41 structures and conformations necessary for virus entry and therefore block HIV entry. It is understood that the method of the present invention can be applied to other viruses where a transmembrane protein or glycoprotein forms structures and complexes that are involved for virus entry. An example of such viruses is an enveloped virus such as HIV. Other examples of viruses include, but are not limited to, an influenza virus, a respiratory syncytial virus, a coronavirus, an Ebola virus, a herpes virus, a hepatitis B virus, a measles virus, a T-cell leukemia virus, and a vesicular stomatitis virus.

Accordingly, in certain embodiments, compounds of the invention can also be administered alone or in conjunction with one or more antiviral agents or agents that reduce the symptoms of a viral disease. Suitable antiviral agents include interferons, protease inhibitors, vidarabine, gancyclovir, nucleoside-analog reverse transcriptase inhibitors such as AZT (zidovudine), ddI (didanosine), ddC (zalcitabine), d4T (stavudine) and 3TC (lamivudine), non-nucleoside reverse transcriptase inhibitors, nevirapine, delavirdine, saquinavir, ritonavir, indinavir, nelfinavir, rimantadine, zidovudine, amnantadine hydrochloride, ribavirin, and acyclovir.

Administration and Pharmaceutical Formulations

Polypeptides (including variants thereof) of the present invention can be administered in various forms, depending on the disorder to be treated and the age, condition, and body weight of the patient, as is well known in the art. An effective amount of a compound (polypeptide) disclosed herein is the amount that partially or completely and prophylactically or therapeutically treats a disease or condition disclosed herein. For example, where the polypeptides are to be administered orally, they may be formulated as tablets, capsules, granules, powders, or syrups; or for parenteral administration, they may be formulated as injections (intravenous, intramuscular, or subcutaneous), drop infusion preparations, or suppositories. For application by the ophthalmic mucous membrane route, they may be formulated as eye drops or eye ointments. These formulations can be prepared by conventional means, and, if desired, the active ingredient may be mixed with any conventional additive, such as an excipient, a binder, a disintegrating agent, a lubricant, a corrigent, a solubilizing agent, a suspension aid, an emulsifying agent, or a coating agent. Although the dosage will vary depending on the symptoms, age and body weight of the patient, the nature and severity of the disorder to be treated or prevented, the route of administration and the form of the drug, in general, a daily dosage of from 0.01 to 2000 mg of the compound is recommended for an adult human patient, and this may be administered in a single dose or in divided doses.

The precise time of administration and/or amount of the agent that will yield the most effective results in terms of efficacy of treatment in a given patient will depend upon the activity, pharmacokinetics, and bioavailability of a particular compound, physiological condition of the patient (including age, sex, disease type and stage, general physical condition, responsiveness to a given dosage, and type of medication), route of administration, etc. However, the above guidelines can be used as the basis for fine-tuning the treatment, e.g., determining the optimum time and/or amount of administration, which will require no more than routine experimentation consisting of monitoring the subject and adjusting the dosage and/or timing.

The phrase "pharmaceutically acceptable carrier" as used herein means a pharmaceutically acceptable material, composition or vehicle, such as a liquid or solid filler, diluent, excipient, solvent or encapsulating material. Each carrier must be "acceptable" in the sense of being compatible with the other ingredients of the formulation and not injurious to the patient.

Formulations usefull in the methods of the present invention include those suitable for oral, nasal, topical (including buccal and sublingual), rectal, vaginal, aerosol, and/or parenteral administration. The formulations may conveniently be presented in unit dosage form and may be prepared by any methods well known in the art of pharmacy. The amount of active ingredient which can be combined with a carrier material to produce a single dosage form will vary depending upon the host being treated and the particular mode of administration. The amount of active ingredient which can be combined with a carrier material to produce a single dosage form will generally be that amount of the compound which produces a therapeutic effect. Generally, out of one hundred per cent, this amount will range from about 1 per cent to about ninety-nine percent of active ingredient, such as from about 5 per cent to about 70 per cent, for example, from about 10 per cent to about 30 per cent.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouthwashes, and the like, each containing a predetermined amount of a therapeutic agent as an active ingredient. A compound may also be administered as a bolus, electuary or paste.

Liquid dosage forms for oral administration include pharmaceutically acceptable emulsions, microemulsions, solutions, suspensions, syrups, and elixirs. In addition to the active ingredient, the liquid dosage forms may contain inert diluents commonly used in the art, such as, for example, water or other solvents, solubilizing agents, and emulsifiers such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor, and sesame oils), glycerol, tetrahydrofuryl alcohol, polyethylene glycols, and fatty acid esters of sorbitan, and mixtures thereof.

Formulations which are suitable for vaginal administration also include pessaries, tampons, creams, gels, pastes, foams, or spray formulations containing such carriers as are known in the art to be appropriate. Dosage forms for the topical or transdermal administration of a therapeutic agent include powders, sprays, ointments, pastes, creams, lotions, gels, solutions, patches, and inhalants. The active component may be mixed under sterile conditions with a pharmaceutically acceptable carrier, and with any preservatives, buffers, or propellants which may be required.

The therapeutic agent can be alternatively administered by aerosol. This is accomplished by preparing an aqueous aerosol, liposomal preparation, or solid particles containing the compound. A nonaqueous (e.g., fluorocarbon propellant) suspension could be used. Sonic nebulizers are preferred because they minimize exposing the agent to shear, which can result in degradation of the compound. Ordinarily, an aqueous aerosol is made by formulating an aqueous solution or suspension of the agent together with conventional pharmaceutically acceptable carriers and stabilizers.

Transdermal patches have the added advantage of providing controlled delivery of an therapeutic agent to the body. Such dosage forms can be made by dissolving or dispersing the agent in the proper medium. Absorption enhancers can also be used to increase the flux of the therapeutic agent across the skin. The rate of such flux can be controlled by either providing a rate controlling membrane or dispersing the peptidomimetic in a polymer matrix or gel.

Pharmaceutical compositions of this invention suitable for parenteral administration comprise one or more polypeptides in combination with one or more pharmaceutically acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution which, in turn, may depend upon crystal size and crystalline form. Alternatively, delayed absorption of a parenterally administered drug form is accomplished by dissolving or suspending the drug in an oil vehicle.

These polypeptides may be administered to humans and other animals for therapy by any suitable route of administration, including orally, nasally, as by, for example, a spray, rectally, intravaginally, parenterally, intracisternally, and topically, as by powders, ointments or drops, including buccally and sublingually.

EXAMPLES

Without further description, it is believed that a person of ordinary skill in the art can, using the preceding description and the following illustrative examples, make and utilize the compounds of the present invention and practice the claimed methods. The following working examples therefore, specifically point out preferred embodiments of the present invention, and are not to be construed as limiting in any way the remainder of the disclosure.

Example 1

Relationship Between Side Chain Structure and 14-Helix Stability of $\beta^3$-Peptides in Water Experimental design and host peptide development. β-peptide 2 (FIG. 1A) (SEQ ID NO: 3) was designed with two changes relative to β-peptide 1 (SEQ ID NO: 2) that were expected to increase 14-helicity into the desired range: the $\beta^3$-homoglycine residue was replaced with a $\beta^3$-homovaline residue and the $\beta^3$-homotyrosine residue was moved to the C-terminus following common practice for α-helical host α-peptides. The CD spectra of β-peptides 1 and 2 in water (FIG. 1B) demonstrate the large effect of these alterations, with a 78% decrease in the mean residue ellipticity minimum at 214 nm ($\Theta_{214}$=-7,450 and -13,320 deg cm$^{-2}$ dmol$^{-1}$ for 1 and 2, respectively).

β-peptide 2 was an excellent reference peptide for a more extensive host-guest analysis for several reasons. First, 2 possesses roughly 48-67% overall helical content, which is within the most sensitive region for detecting net changes. Second, the $\beta^3$-homoalanines at the 3, 6, and 9 positions of 2 provided excellent points for side chain substitution. The methyl side chain is ideal for substitution, and because each substituent's (i+3) and/or (i−3) neighbors are restricted to methyl groups, guest side chain-host side chain interactions are minimized. Third, by substituting into these three positions individually, three independent assessments of helix propensity can be made: one near the N-terminus, one in a central position, and one near the C-terminus.

Host-guest analysis. β-peptide 2 was used as a reference peptide for a host-guest analysis of the 14-helix propensities of a wide variety of $\beta^3$-amino acids. The 28 $\beta^3$-peptides used for the analysis represent the host peptide and 27 variants in which each of three positions was substituted with each of nine different proteinogenic side chains. These side chains varied widely in functionality, and included charged, aliphatic, polar, and aromatic groups. In the following discussion, the terms "stabilizing" and "destabilizing" will be used in reference to $\beta^3$-homoalanine (the residue present in the host peptide 2) unless otherwise noted, and percent changes in 14-helicity will be calculated based on intensity of CD minima near 214 nm relative to that of the host peptide. Each peptide was analyzed by CD in PBC buffer at neutral pH, at 25° C., over a range of concentrations. A subset of nine peptides was also characterized by analytical ultracentrifugation (AU) to determine oligomeric state. The molecules chosen for AU analysis represent a variety of substitutions among the three positions, while also including those peptides found to have slightly concentration-dependent CD spectra. While curve fits for monomer and dimer molecular weights were equally valid, a characteristic of low molecular weight compounds, the material balance calculations show that all peptides tested by AU were monomeric at concentrations ranging from 80 to 400 μM.

Figure 2:
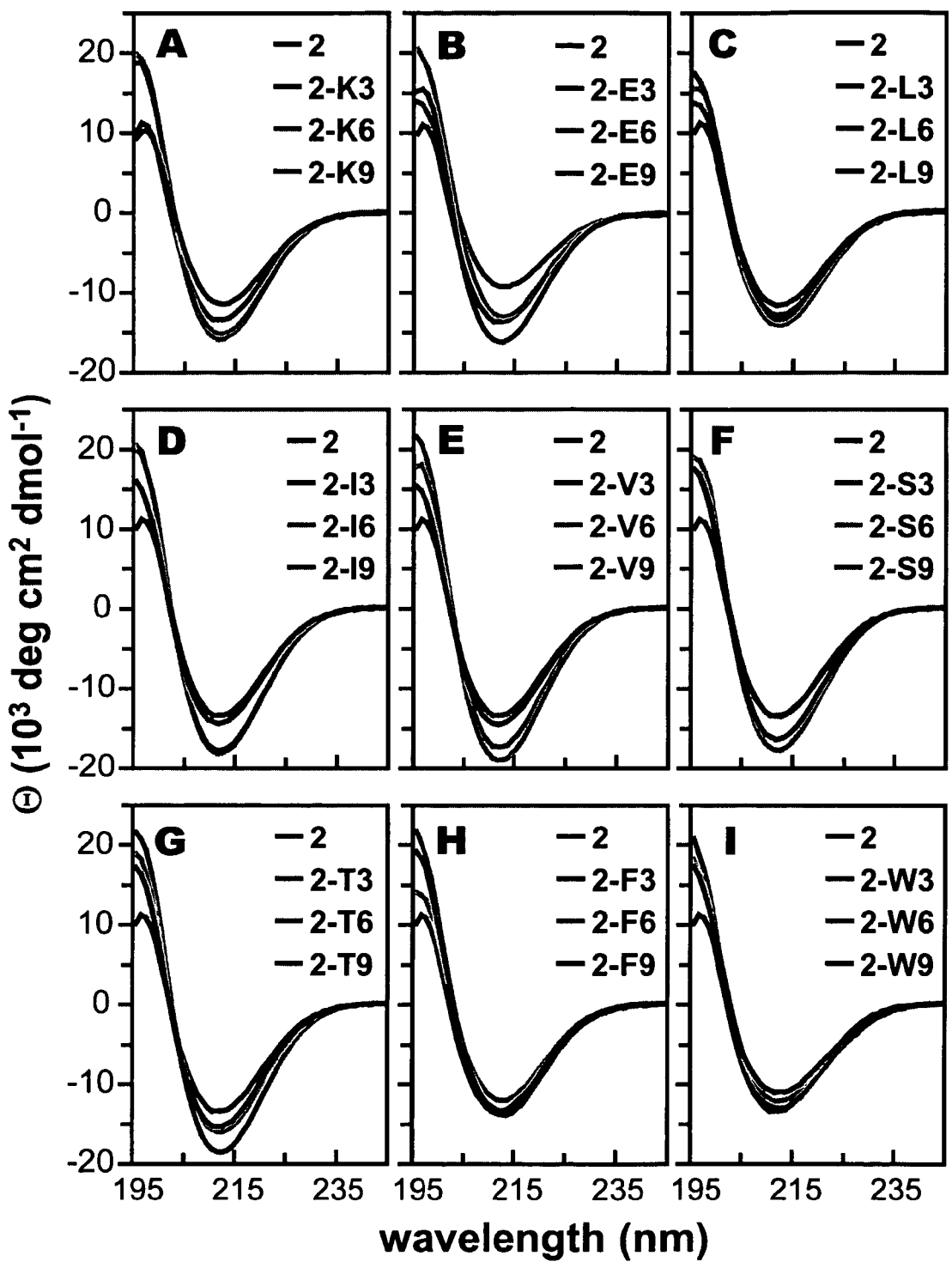
FIG. 2 shows circular dichroism spectra of $\beta^3$-peptide variants of 2 containing substitutions at position 3, 6, or 9 with: (a) $\beta^3$-homolysine (2-K3, 2-K6, 2-K9), (b) $\beta^3$-homoglutamic acid (2-E3, 2-E6, 2-E9), (c) $\beta^3$-homoleucine (2-L3, 2-L6, 2-L9), (d) $\beta^3$-homoisoleucine (2-I3, 2-I6, 2-I9), (e) $\beta^3$-homovaline (2-V3, 2-V6, 2-V9), (f) $\beta^3$-homoserine (2-S3, 2-S6, 2-S9), (g) $\beta^3$-homothreonine (2-T3, 2-T6, 2-T9), (h) $\beta^3$-homophenylalanine (2-F3, 2-F6, 2-F9), or (i) $\beta^3$-homotryptophan (2-W3, 2-W6, 2-W9). Spectra were acquired in PBC buffer at 25° C. and a $\beta^3$-peptide concentration of 80 μM.

Charged side chains modulate 14-helix stability in a position-dependent way. $\beta^3$-homoglutamic acid and $\beta^3$-homolysine were substituted individually at each of the three positions within 2. The CD spectra for peptides 2-K3, 2-K6, 2-K9, 2-E3, 2-E6, and 2-E9 (compounds 1-6) (SEQ ID NOS: 4-9) are shown in FIGS. 2A-B. In agreement with expectation, when located near the N-terminus (position 3), $\beta^3$-homolysin increases the extent of 14-helix structure by 20% and $\beta^3$-homoglutamic acid decreases the extent of 14-helix structure by 31%. When located near the C terminus (position 9), $\beta^3$-homolysine diminishes the extent of 14-helix structure by 13% and $\beta^3$-homoglutamic acid increases the extent of 14-helix structure by 21%. In a more central position (position 6), $\beta^3$-homolysin is moderately stabilizing (15% increase) and $\beta^3$-homoglutamic acid is neutral to slightly destabilizing.

Aliphatic side chains. The effects of aliphatic side chains on the 14-helix stability of 2 were examined next. The host-guest study directly addresses the question of whether side chains branched at the first side chain carbon are 14-helix stabilizing. The iso-propyl (2-V3, 2-V6, 2-V9, compounds 7-9) (SEQ ID NOS: 10-12), iso-butyl(2-I3, 2-I6, 2-I9, compounds 10-12) (SEQ ID NOS: 13-15), and sec-butyl (2-L3, 2-L6, 2-L9, compounds 13-15) (SEQ ID NOS: 13-15) side chains were used to examine the effects of branching on overall 14-helicity.

The CD spectra of 2-V3, 2-V6, 2-V9, 2-I3, 2-I6, 2-I9, 2-L3, 2-L6, and 2-L9 are shown in FIGS. 2C-E. In accord with previous observations, the sec-butyl side chain of $\beta^3$-homoleucine is either 14-helix destabilizing (by 12% at position 3) or neutral (at positions 6 and 9). However, the iso-propyl and iso-butyl side chains of $\beta^3$-homovaline and $\beta^3$-homoisoleucine are 14-helix-stabilizing at all positions. The effect is greatest in central and N-terminal positions, where a $\beta^3$-homovaline or $\beta^3$-homoisoleucine residue lowers the mean residue ellipticity minimum from −13,320 deg cm$^{-2}$ dmol$^{-1}$ (for the host $\beta$-peptide 2) to −17,440 and below, as low as −19,130 deg cm$^{-2}$ dmol$^{-1}$ for $\beta$-peptide 2-V6. These values represent increases in mean 14-helix structure of 31 to 44% relative to the host peptide. The consistently large increases observed for individual substitutions of aliphatic side chains branched at the first side chain carbon directly confirm that these residues are particularly 14-helix-promoting.

Polar side chains. To further explore 14-helix propensities of $\beta^3$-amino acids, two polar residues were chosen for substitution. The hydroxymethyl side chain of $\beta^3$-homoserine and the 1-hydroxyethyl side chain of $\beta^3$-homothreonine seemed suitable, and had the added benefit of testing the effect of branching at the first side chain carbon within a different context. The CD spectra for peptides 2-S3, 2-S6, 2-S9, 2-T3, 2-T6, and 2-T9(compounds 16-21) (SEQ ID NOS: 19-24) are shown in FIGS. 2F-G. Unexpectedly, the $\beta^3$-homoserine substitution is stabilizing at positions 6 and 9 (by 34% and 24%, respectively), but neutral at position 3. $\beta^3$-homothreonine, by contrast, is stabilizing at all three positions, lowering the mean residue ellipticity minimum near 214 nm as low as −18,720 deg cm$^{-2}$ dmol$^{-1}$ for 2-T3, corresponding to a 41% increase in 14-helical structure. The changes upon substitution with $\beta^3$-homothreonine are similar to those seen for other side chains branched at the first carbon, providing further evidence that these side chains are particularly 14-helix promoting. However, since the unbranched hydroxymethyl side chain appears to be stabilizing to an equal or greater extent than the branched side chain, and since this effect is position-dependent, there may be another stabilizing interaction present involving the hydroxyl group.

Aromatic side chains. Extensive analyses of known protein-protein interfaces have shown that large hydrophobic residues occur with higher frequency in surface recognition patches. These residues are also commonly involved in important pairwise interactions that stabilize protein-protein complexes. Thus, the ability to incorporate large hydrophobic residues is critical to the use of $\beta$-peptides as peptide and protein mimics. Three large aliphatic residues had already been examined, so to test the 14-helix propensity of large aromatic residues $\beta^3$-homophenylalanine and $\beta^3$-homotryptophan were substituted into $\beta$-peptide 2 (compounds 22-27) (SEQ ID NOS: 25-30). The CD spectra for the $\beta$-peptides with aromatic substitutions are shown in FIGS. 2H-I. The benzyl sidechain (analogous to that of phenylalanine) was 14-helix neutral in positions 3 and 9, and destabilized 14-helix structure by only 10% in the central position. The methylindole sidechain (analogous to that of tryptophan) was neutral at position 3, and slightly destabilizing in the other positions (up to 17%). These results provides optimism that even bulky aromatic side chains will be tolerated within the context of a reasonably stable $\beta$-peptide 14-helix.

Electrostatic screening. Debye-Hückel theory states that the energy of ion-ion electrostatic interactions should scale negatively with the square root of the salt concentration in molality. Previously, $\beta$-peptides with 14-helical structure stabilized by electrostatic interactions have been shown to unfold in the presence of high salt, in accordance with this principle. To provide additional evidence that electrostatic interactions contribute to the stabilities of the $\beta$-peptides studied here the effects of increasing concentrations of NaCl on the structure of peptides 2 and 2-I6 were monitored. The results were similar to that of other salt-bridge-stabilized $\beta$-peptides, and demonstrated that screening of electrostatic interactions destabilizes the 14-helix. The curves for peptides 2 and 2-I6 are roughly parallel, implying that the methyl iso-butyl substitution stabilizes the 14-helical fold in a manner unrelated to electrostatics, and that even when electrostatic interactions are highly screened, the iso-butyl side chain can stabilize 14-helical structure. Thus, the effects of salt-bridging and branched sidechain substitution are independent. This observation is consistent with a model in which 14-helix folding is noncooperative, so that destabilization of one portion of the helix does not affect the stability of the rest of the helix.

Conformational analysis of $\beta^3$-oligopeptides. 25 $\beta^3$-oligopeptides with the general sequence acetyl-$(\beta^3A)_m$-$\beta^3X$-$(\beta^3A)_n$-NHCH$_3$, m+n=11, where $\beta^3X$ was one of $\beta^3A$, $\beta^3L$, $\beta^3I$, $\beta^3V$, $\beta^3S$, or $\beta^3T$ at positions 3, 6, 9, or 12 were energy-minimized. The relative energies of these $\beta^3$-oligopeptides were examined using a variety of starting conformations. The three backbone dihedral angles $(\phi, \theta, \psi)$ for all residues were initially set to values corresponding to the C6 (110°, 60°, 180°), C8 (−66°, −45°, 95°), $\beta$-sheet (180°, 180°, 180°), 12-helix (−90°, 90°,−110°) or 14-helix (−155°, 60°, −135°) conformations. These starting points were all minimized in the gas phase, and their energies of solvation in water were calculated using the Generalized Born/Surface Area (GB/SA) model in a manner that differentiates native folds from decoys, although previous applications of this technique employed an equivalent formulation of the same principle. The minimized $\beta$-peptide energies predict that the 14-helix should be the lowest-energy conformation for $\beta^3$-oligopeptides, followed by the 12-helix, which matches experimental observations.

The results from energy minimizations report on the lowest-energy structures of each $\beta$-peptide at 0 K. While they can predict relative energies for conformations of a single $\beta$-peptide, the energies are not truly comparable across different peptides and different substitutions. In order to obtain a more general basis for comparison, Monte Carlo (MC) simulations at 25° C. using the GB/SA solvation model were performed, using each of the minima obtained through energy minimization as starting conformations. For each simulation the equilibration period spanned 8 million configurations, after which data was collected and averaged for 2 million configurations more. The average energies for each MC ensemble confirm that the 14-helix is the most stable conformation for all $\beta^3$-oligopeptides studied. The 12-helix is, on average, 33 kcal·mol$^{-1}$ higher in energy, but still stable, while all the other starting conformations (C6, C8 and β-sheet) folded to other, more compact structures. Comparing energies for substituted β-peptides with those of the simulated host, acetyl-(β$^3$A)$_{12}$-NHCH$_3$, reveals that the β$^3$S and β$^3$T substitutions are most 14-helix stabilizing in these simulations, followed by β$^3$V and then β$^3$I, β$^3$A and β$^3$L.

Structural properties of the simulated β$^3$-oligopeptides. The 14-helix content of each simulated β$^3$-oligopeptide can be estimated directly from the MC simulation data by quantifying structural properties, specifically the hydrogen bond populations and average torsional angles. Significantly, the average population of the N-terminal hydrogen bond over all the simulations is only 39%, while the average population of the C-terminal hydrogen bond is 77%. On this basis it would be predicted that stabilizing effects would be more pronounced at positions near the N-terminus. This prediction matches the CD results, with the sole exception of β$^3$-oligopeptides containing a β$^3$S residue. Applicants also compared the hydrogen bond populations near each substitution site in each of the β$^3$-oligopeptides studied, calculated as the average population of the (i–2→i), (i–1→i+1), and (i→i+2) hydrogen bonds surrounding a substitution at position (i) over 2 million configurations. In all cases there are only small effects at the middle positions, presumably because at these positions the hydrogen bond populations are already high in the all-β$^3$A peptide. Even so, several trends can be discerned by comparing the relative hydrogen bond populations. Substitution of β$^3$L within an all-β$^3$A peptide has little or no effect on hydrogen bond populations at positions 3, 6, and 9, and a slight decrease at the C-terminal position 12. By contrast, single substitutions of β$^3$I, β$^3$V, and β$^3$S show large increases in hydrogen bond population at the N-terminus and moderate increases at the C-terminus, while β$^3$-T moderately increases hydrogen bond populations at both termini. These observations match the CD data very well.

The Monte Carlo simulations indicate that, within a fully 14-helical conformation, the side chain hydroxyl groups of β$^3$S and β$^3$T can hydrogen bond to the (i+2) carbonyl oxygen when available. When substituted at internal positions 6 and 9, β$^3$S and β$^3$T formed these side chain hydrogen bonds in 68% and 35% of the configurations sampled, respectively. This observation implies β$^3$S is more likely to form these stabilizing H-bonds within a fully 14-helical context, and may explain the unexpected stabilizing effects observed by CD upon β$^3$S substitution.

Another noticeable structural difference among the MC simulations of the 25 peptides is in the average backbone θ torsion (N—C$^3$—C$^2$—C') at the substituted position. Within the context of a β$^3$-oligopeptide, the average θ torsional angles for β$^3$L (48°) and β$^3$S (49°) residues are very similar to values for β$^3$A in the same positions (52°), and these three deviate significantly from the optimal gauche torsion found for energy-minimized dipeptides (60°). β$^3$I (60°) and β$^3$V (59°) promote torsions very close to optimal, while β$^3$T has a torsional angle that is intermediate (54°). The distorted torsions appear to allow better interaction of the (i, i+3) side chains at the expense of a slight distortion of the helical axis, which does not seem to affect the hydrogen bond distances. Overall, the hydrogen bond populations and torsional geometries of singly substituted oligo-β$^3$-homoalanine help to explain the general trends observed in the CD data, as well as confirm that 14-helix propensities appear to arise from inter-residue interactions.

Discussion

The wide range of CD intensities observed indicate strong thermodynamic preferences among β$^3$-amino acids for or against 14-helix structure.

β$^3$-homolysine is more 14-helix-stabilizing than β$^3$-homoglutamic acid in the center of the β-peptide 14-helix. It is unclear whether this difference is due to electrostatics, or to some other intrinsic side chain property, though in α-helical models lysine has been consistently more helix-stabilizing than glutamic acid.

Among non-charged side chains the 14-helix propensities of β$^3$-amino acids contrast starkly to the α-helix propensities of their α-amino acid counterparts. The methyl side chain (alanine) is among the most α-helix-promoting, but is one of the least 14-helix-stabilizing side chains in the present study. The same is true for the sec-butyl side chain (leucine and β$^3$-homoleucine). Meanwhile, the iso-butyl side chain of isoleucine, which has moderate α-helix propensity, the iso-propyl side chain of valine, which has very low α-helix propensity, and the 1-hydroxyethyl side chain of threonine, which also has very low α-helix propensity, are all highly 14-helix stabilizing relative to the methyl side chain. The broad discrepancies among individual side chain propensities for α-helices and 14-helices imply that the folding of these secondary structures may be governed by very different biophysical forces, and speak to the mechanism underlying intrinsic helix propensities.

The stabilizing effect of side chains branched at the first carbon. Observations from as far back as 1999 imply that β$^3$-amino acids branched at the first carbon are 14-helix-stabilizing. The present study examines the relative effects of methyl, iso-propyl, iso-butyl, and sec-butyl side chains on 14-helicity within the context of an already 14-helical scaffold, and directly demonstrates that a single side chain branched at the first carbon can have a large stabilizing effect on overall 14-helicity. Calculations on singly substituted oligo-β$^3$-homoalanine peptides also predict this effect, while no such effects are seen upon an extended conformational analysis of monomeric β$^3$-amino acids.

Large hydrophobic side chains are well-tolerated. Positioning large, hydrophobic residues at (i, i+3) positions within a 14-helical context would generate an extensive, continuous hydrophobic surface with the potential to bind a target with high affinity. β$^3$-homovaline and β$^3$-homoisoleucine are 14-helix promoting, and substitutions of β$^3$-homoleucine, β$^3$-homophenylalanine and β$^3$-homotryptophan reveal that these large hydrophobic β$^3$-amino acids are neutral or only slightly destabilizing relative to β$^3$-homoalanine. This finding highlights the robustness and versatility of the 14-helical host peptide, and supports its suitability as a scaffold for molecular recognition.

A scaffold for molecular recognition. The host-guest analysis as a whole validates peptide 2 as an excellent folded scaffold for molecular recognition. At its present length it is able to present up to four side chains in a linear arrangement. The scaffold might easily be extended in increments of six residues (to retain the favorable salt-bridging and charge-macrodipole interactions) or be further substituted on the β$^3$-homovaline-bearing face, yielding an even larger surface area for incorporation of function.

Experimental

General. Fmoc-protected α-amino acids, PYBOP®, HOBt, and Wang resin were purchased from Novabiochem (San Diego, Calif.). Dimethylformamide (DMF), N-methyl-2-pyrrolidone (NMP), N-methyl morpholine (NMM), trifluoroacetic acid (TFA), and piperidine were purchased from American Bioanalytical (Natick, Mass.). All other reagents were purchased from Sigma-Aldrich. Certain Fmoc-$\beta^3$-(L)-amino acids were purchased from Peptech Corp. (Cambridge, Mass.), although most were synthesized from enantiomerically pure α-amino acid precursors via the Arndt-Eistert procedure.[15]

$\beta^3$-peptide synthesis, manual procedure. Some $\beta^3$-peptides were synthesized manually, in a glass peptide synthesis vessel with fritted glass at the top and bottom and a sidearm for addition of reagents (Ace Glass, Vineland, N.J.). Peptides were synthesized on a 30 or 50 μmole scale using Wang resin and Fmoc-protected $\beta^3$-amino acid monomers, using standard Fmoc strategy. Wang resin was loaded as described.[26] Peptide elongation and cleavage were performed essentially as described.[26]

$\beta^3$-peptide synthesis, semi-automated procedure. Some $\beta^3$-peptides were synthesized on a Symphony/Multiplex automated peptide synthesizer (Protein Technologies, Tuscon, Ariz.) using standard Fmoc strategy. Peptides were synthesized on a 25 μmole scale using Wang resin loaded as described.[26] One cycle of peptide elongation consisted of the following steps: resin was washed with N-methyl-2-pyrrolidone (NMP) (3×30 sec), deprotected with 20% piperidine/DMF (1×2 min, 2×8 min), washed with NMP (6×30 sec), coupled for 30 mins with 3 equiv. of the appropriate $\beta^3$-amino acid and 3 equiv. PYBOP®, 3 equiv. HOBt, and 8 equiv. DIEA, washed once with NMP (1×30 sec), capped for 20 mins with 6% v/v acetic anhydride, 6% v/v NMM in NMP, then washed with NMP (2×30 sec). The $\beta^3$-amino acid (3 equivalents, 75 μmol), PYBOP® (39.0 mg, 75 μmol), and HOBt (11.4 mg, 75 μmol) were weighed out previously, and dissolved in 5 mL NMP immediately prior to coupling. Diisopropylethylamine (DIEA) (8 equivalents, 35 μL) was added immediately prior to adding the reagents to the resin through the peptide synthesis vessel sidearm. Cleavage of peptides synthesized semi-automatically was performed as follows: the resin was washed with NMP (8×30 sec), washed with methylene chloride (8×30 sec), dried 20 mins under $N_2$, cleaved for two hours with cleavage reagent (3% v/v water, 3% v/v triisopropylsilane in TFA), then washed once with cleavage reagent. The cleaved peptide was collected and concentrated by rotary evaporation, reconstituted in $H_2O$/$CH_3CN$ (1:1), and analyzed for purity by HPLC and MALDI-TOF mass spectrometry.

β-peptide purification and characterization. Peptides were purified by reverse-phase HPLC. Identity and purity of compounds was assessed by analytical HPLC and MALDI-TOF (matrix-assisted laser desorption-ionization time-of-flight) mass spectrometry on a Voyager (Applied Biosystems) MALDI-TOF spectrometer with a 337 nm laser using the ac-cyano-4-hydroxycinnaminic acid matrix. The instrument was calibrated using adrenocorticotropic hormone (ACTH) ($M+H^+$=2093.1) and angiotensin I ($M+H^+$=1296.7). Following purification, peptides were immediately lyophilized, kept at −20° C., and reconstituted just prior to use.

Circular dichroism. Circular dichroism (CD) spectra between 195 and 260 nm were acquired with an Aviv 202 CD spectrometer at 25° C. using a 2 mm path length quartz cell (Hellma, Plainview, N.Y.). Samples were prepared by dissolving lyophilized, HPLC-purified peptide in PBC buffer (1 mM each phosphoric acid, boric acid, and citric acid, pH adjusted with NaOH to 7.0). The concentration of the sample was determined by measuring absorbance at 280 nm; this analysis assumes that the extinction coefficient of a β-peptide containing a single β3-homotyrosine is equal to that of an α-peptide containing a single α-tyrosine (1300 $M^{-1}$ $cm^{-1}$ at 280 nm), as used previously to estimate β-peptide concentration. Peptide was diluted to 80 μM in PBC buffer, and serial dilutions were then made to generate solutions of 40, 20, and 10 μM. Three scans of each peptide solution were taken, with 2 sec averaging times and 2 nm bandwidth. These scans were averaged, and a blank buffer spectrum was subtracted to generate the corrected spectra. This full procedure was performed three independent times to ensure accuracy and repeatability, and these three spectra were averaged to generate the final spectrum for each peptide at each concentration. No data smoothing was used at any step. CD signal was converted into mean residue ellipticity ([Θ], deg $cm^2$ $dmol^{-1}$) using the equation:

$$[\Theta] = \Psi/(100 \text{ res} \cdot l \cdot c)$$

where Ψ is raw ellipticity in degrees, res is the number of residues, l is path length in decimeters, and c is molar concentration. The concentration of each CD sample was verified after analysis by repeating the UV absorbance measurement. Aromatic side chains are known to contribute to the far-UV CD of model α-helical peptides in a manner highly dependent on local backbone conformation. It is not yet known whether these contributions are sizable for $\beta^3$-peptide 14-helices, though any future corrections for the C-terminal $\beta^3$-homotyrosine will likely be small and uniform within the series. Contributions from the $\beta^3$-homophenylalainine and $\beta^3$-homotryptophan residues used as guest side chains might more significantly affect the conclusions regarding β-peptides containing these residues, but any future corrections are unlikely to be of a magnitude of more than±5%. Experiments with constrained peptides have shown that fully 14-helical, short β-peptides may have mean residue ellipticity minima at 214 nm as low as $\Theta_{214}$=−20,000 deg $cm^2$ $dmol^{-1}$, whereas longer β-peptides (about 15 residues) may have minima as low as −28,000 deg $cm^2$ $dmol^{-1}$ (for amino acids with S chirality at the substituted backbone carbon; R chirality reverses the handedness of the helix and a maximum of 20,000 deg $cm^2$ $dmol^{-1}$ or higher is seen).

The effects of electrostatic screening were monitored by acquiring CD spectra of 80 μM peptide at concentrations of NaCl from 0 to 2.25 M. Salt concentration was varied by stepwise addition of high-salt buffer to a sample of peptide within the CD cell, followed by mixing by aspiration and a 20 minute equilibration. Spectra were taken at 25° C. using a 2 nm bandwidth and 5 sec averaging time, and results were adjusted for cumulative changes in salt concentration, peptide concentration and total volume.

Analytical ultracentrifugation. Measurements were made using an Optima XLI analytical ultracentrifuge from Beckman-Coulter (Fullerton, Calif.). Samples were prepared by dissolving HPLC-purified peptide in PBC buffer and were centrifuged to equilibrium at 25° C. at 50,000 RPM in six-channel, carbon-epoxy composite centerpieces supplied by Beckman. Equilibrium was assessed by the absence of significant change in radial concentration gradients in scans at 14 and 16 hours. Data were analyzed by fitting the data to the equation for a single ideal species using Igor-Proo (Wavemetrics, Lake Oswego Oreg.). The equation is:

$$C(r) = C(r_o) \exp\left\{ \frac{(1-\bar{v}\rho)\omega^2 M_n}{2RT}(r^2 - r_o^2) \right\}$$

where:
$C(r,r_o)$=concentration (any units) of sedimenting species at radial positions r,$r_o$ cm from the center of rotation.

v̄=partial specific volume of sedimenting species (cc/gm)
ρ=density of supporting buffer (gms/cc)
ω=angular velocity of rotor (radians/sec)
$M_n$="Molar" molecular weight of sedimenting species (gms/mole)
R=Gas constant ($8.315 \times 10^7$ ergs $K^{-1}$ $mol^{-1}$)
T=Temperature (K)

Peptide partial specific volumes were assumed for simplicity to be the same as the average value calculated for previously studied β-peptides: 0.785 $cm^3$/gm. Because of cross-correlation of molecular weight with baseline values, curve-fits were insensitive to variations in this value. In fact, equally good curve-fits could be obtained by assuming either monomer or dimer molecular weights. This ambiguity is an unavoidable consequence of the low curvature exhibited in the concentration profiles of the low molecular weight compounds. To distinguish monomers from higher order aggregated species as the dominant population, curve fits were performed using integral multiples of the sequence-calculated molecular weights. This fixes the molecular weight of the presumed species, which also fixes the baseline (absorbance at zero concentration). Then, one can integrate over the net absorbance profile, to obtain the calculated average concentration in the cell. Here, the average concentrations predicted by fixing the molecular weights to those of the monomers are larger and more consistent with known concentrations than those predicted by fixing the molecular weights to dimer values. This is because the higher molecular weights predict higher curvature which, for the same data set, can only be attained by increasing the baseline values and hence reducing the calculated average concentrations. This represents a useful material balance criterion previously developed to study binding of low and high molecular weight compounds. Error in the calculated values represents the sum of uncertainties in the determination of the outer radius of the cell compartment and uncertainties arising from baseline values as reported from the curve-fitting algorithm.

Computational analysis. All the dipeptide minimizations were done with the BOSS 4.5 program, modified so that the bonding list was taken from the input Z-matrix and not recalculated based on interatomic distances. All the calculations for oligo-β-peptides were carried out with the development version of MCPRO 1.68 which includes the GB/SA treatment for solvent. The OPLS-AA force field was used throughout this study, augmented with backbone torsional parameters developed specifically for β-peptides based on high level ab initio calculations. In all cases the torsion angles around the peptide bond (ω) were initially set to 180° but allowed to vary freely. All possible degrees of freedom were allowed to vary in all calculations, with the exception of the dipeptide three-dimensional Ramachandran plots where the backbone dihedrals were fixed. Due to convergence problems, particularly with conformations that have very close non-bonded contacts, the dipeptide minimizations were done in triplicate with the BFGS, Fletcher-Powell, and Powell algorithms, and the resulting conformer with the lowest energy was used. The oligopeptide optimizations were started with 250 steps of steepest descent minimization before switching to a conjugate gradients algorithm until convergence was reached. This treatment was not sufficient for 5 of the cases, which had to be optimized using 5000 steepest-descent steps before switching to conjugate gradients. No cutoff was used (i.e. all non-bonded pairs evaluated), and convergence criterion was set to 0.1 cal $mol^{-1}$ for all minimizations. MC simulations were done using W. C. Still's GB/SA solvation model.

Conclusions. The present study has revealed β³-peptides with unprecedented overall 14-helicities in water. These β-peptides are made from the synthetically accessible and diverse β³-amino acids, and require no ring constraints to achieve folding. The most 14-helical β-peptide generated, 2-V6, has a mean residue ellipticity minimum at 214 nm ($MRE_{214}$) of $-19,130\pm340$ deg $cm^2$ $dmol^{-1}$ in aqueous solution, indicating mean helix structure of up to 95%. This rivals the values observed for the most 14-helical β-peptides observed to date in methanol or in micelles, even those with cyclic residues. The 14-helix propensities of β³-amino acids observed in this study contrast sharply with the α-helix propensities of corresponding α-amino acids. This data, along with other evidence, demonstrates that 14-helix folding is governed by radically different biophysical forces than is α-helix folding. Finally, the present study belies the assumption that unconstrained β³-amino acids cannot form highly structured 14-helices in water, and demonstrates that diverse functionality can be incorporated into such a stable helix through simple substitution.

Example 2

Helical β-peptide Inhibitors of the p53-hDM2 Interaction hDM2 is recognized in vivo by a short α-helix within the activation domain of p53 (p53AD), the transcription factor that controls cell fate in response to stress. hDM2 negatively regulates p53 function and disruption of the p53·hDM2 interaction is an important cancer therapy goal. Three residues on one face of p53AD (F19, W23, and L26) comprise the functional epitope that contributes heavily to the binding energy. Modification of a p53AD-based α-peptide with non-natural α-amino acids that improve helix stability and surface complementarity results in a potent inhibitor that activates apoptosis in vivo. However, non-α-peptidic inhibitors are far less potent.

Figure 3:
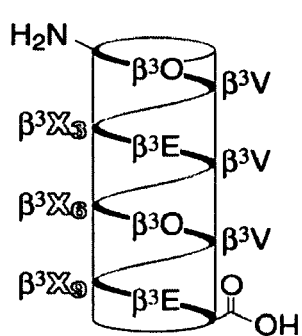
FIG. 3 shows helical net diagrams of $\beta^3$-peptides studied in Example 2. $\beta^3$X denotes a $\beta^3$-homoamino acid where X is the one-letter code for the corresponding $\alpha$-amino acid.
Figure 3:
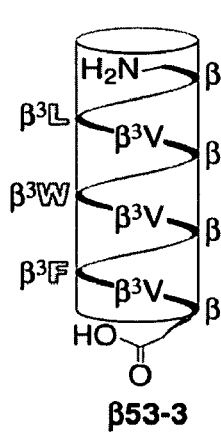
Figure 3:
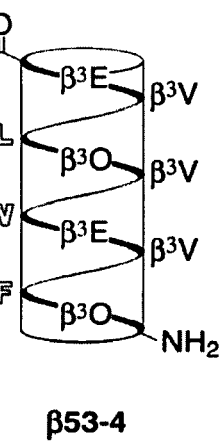
Figure 3:
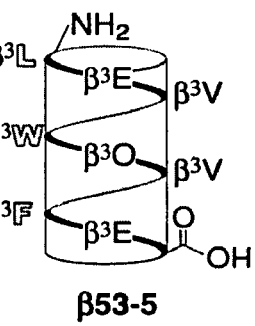
Figure 3:
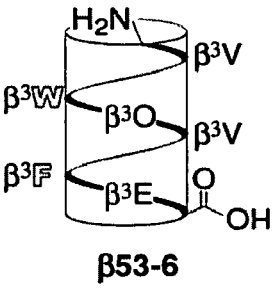
Figure 3:
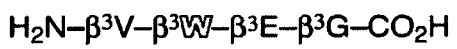

The experimental design began with a β³-decapeptide with significant 14-helix stability in aqueous solution due to electrostatic macrodipole stabilization and side chain-side chain salt bridges on one helical face. Although the dimensions of a 14-helix differ from those of an α-helix, it was hypothesized that the p53AD functional epitope would be recapitulated if the side chains of F19, W23, and L26 were presented at successive positions three residues apart on a stabilized 14-helix. Four β³-peptides were designed in which these side chains are appended in both possible orientations on each of the two available 14-helix faces (β53-1-4, Compounds 28-31, FIG. 3) (SEQ ID NOS: 31-34).

Figure 4:
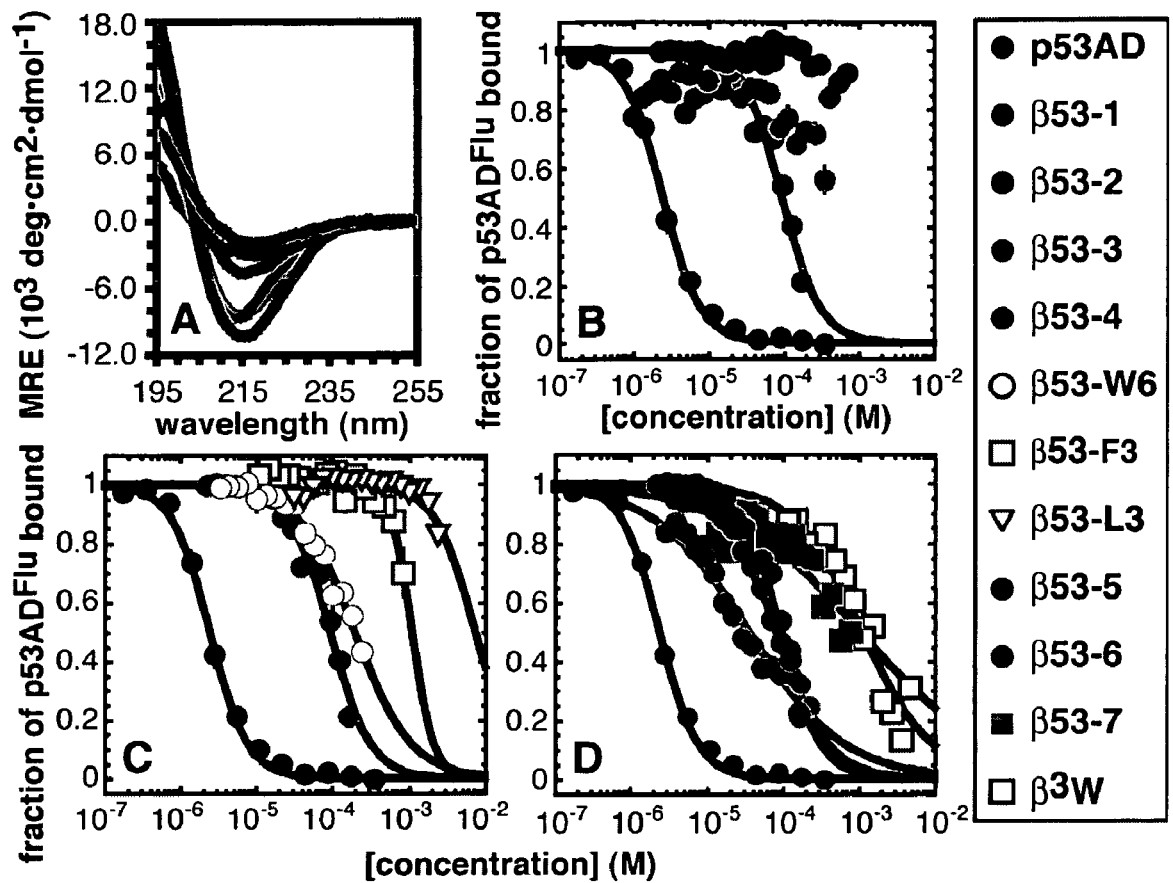
FIG. 4 shows (A) CD spectra of $\beta$53-1-6 in PBC buffer (pH 7.0) at 25° C. at peptide concentrations of 160 μM, except $\beta$53-2, which was 22 μM, and (B-D) inhibition of p53AD$^{Flu}$·hDM2 complexation by p53AD, $\beta^3$-peptides, and $\beta^3$W.

The circular dichroism (CD) spectra of β53-1-4 in aqueous buffer were compared to estimate their 14-helix content (FIG. 4A). The CD signature of a 14-helix is clearly evident, and the relative minima at 214 nm suggest helical contents between 30 and 50% for β53-1, 3, and 4. Two-dimensional NMR spectroscopy in $CD_3OH$ confirmed the presence of 14-helix structure in β53-1: ROESY spectra showed four of seven possible $C_\alpha H(i) \to C_\beta H(i+3)$ ROEs and two of six possible $C_N(i) \to C_\beta(i+3)$ ROEs characteristic of the 14-helical conformation. Additional ROEs may be present but were obscured by resonance overlap; no ROEs inconsistent with 14-helical structure were observed. Analytical ultracentrifugation revealed that β53-1, 3 and 4 were monomeric at concentrations between 80 and 400 μM, confirming that these 14-helices are stabilized by intramolecular interactions.

A competition fluorescence polarization (cFP) assay was designed using $hDM2_{1-188}$ (hDM2) and a fluorescein-labeled $p53AD_{15-31}$ peptide ($p_{53}AD^{Flu}$) to monitor inhibition of p53AD·hDM2 complexation by β53-1-4. The $K_d$ of $p53AD^{Flu}$·hDM2 measured by direct fluorescence polarization analysis was 0.34±0.11 μM, consistent with previous work. Unlabeled p53AD$_{15-31}$ inhibited the p53AD$^{Flu}$·hDM2 interaction with an IC$_{50}$ of 2.47±0.11 μM, a value that matches those reported in similar assays. Two β$^3$-peptides, β53-1 and β53-3, inhibited p53AD$^{Flu}$·hDM2 complexation with IC$_{50}$ values of 94.5±4.4 μM and 1589±104 μM, respectively (FIG. 4B), but only β53-1 failed to inhibit formation of the unrelated CREB KID·CBP KIX complex; β53-3 was not studied further.

Next a series of β$^3$-decapeptides were prepared to assess whether the affinity of β53-1 for hDM2 required all or part of the functional epitope composed of p53AD side chains F19, W23, and L26. β$^3$-peptides β53-W6, β53-F9, and β53-L3 (Compounds 32-34) (SEQ ID NOS: 35-37), in which two of these three side chains were changed to β$^3$-homoalanine, inhibited p53AD·hDM2 complexation with IC$_{50}$ values of 198.1±10.0, 1701±163, and >7000 μM, respectively (FIG. 4C). β53-W6, which retained β$^3$-homotryptophan (β$^3$W), was the most potent inhibitor, with an IC$_{50}$ value 2-fold higher than that of β53-1, whereas β53-F9, which retained β$^3$-homophenylalanine (β$^3$F), was moderately potent. Importantly, the relative arrangement of β$^3$W and β$^3$F was critical: β$^3$-peptides containing different arrangements of these residues, β53-2 and 4, showed no inhibition at 70 and 700 μM, respectively, and others with a single β$^3$F residue (β53-F3, β53-F6, Compounds 35-36) (SEQ ID NOS: 38-39) showed no inhibition at 1 mM. In addition, β$^3$-peptides with a single β$^3$L residue (β53-L3, β53-L6, β53-L9, Compounds 34 and 37-38) (SEQ ID NOS: 37 and 40-41) showed no inhibition at concentrations as high as 20 mM, and those with a single β$^3$I residue (β53-I3, β53-I6, β53-I9, Compounds 39-41) (SEQ ID NOS: 42-44) showed no inhibition at concentrations as high as 1 mM. These data indicate that β53-1 interacts with hDM2 with specific contributions from two of three residues comprising the p53AD functional epitope, (β$^3$W and β$^3$F. The relative importance of β$^3$W, β$^3$F, and β$^3$L in the context of β53-1 is consistent with data for p53AD-based α-peptides.

The modest contribution of β$^3$L3 to hDM2 binding by β53-1 led Applicants to re-examine its interactions with hDM2 in a model that maximized superposition of the β$^3$W and β$^3$F chains of β53-1 with W23 and F19 of p53AD. This analysis suggested that residues 1-3 of β53-1 cannot access the 14-helix conformation when bound, and that N-terminally truncated β53-1 variants might be better inhibitors. To test this hypothesis, β53-5 and β53-6 (Compounds 42-43) (SEQ ID NOS: 45-46) were synthesized, which lack residues 1-2 or 1-4 (including the β$^3$L at position 3) of β53-1, respectively (FIG. 3). β53-5 inhibited the p53AD$^{Flu}$·hDM2 interaction more potently than did β53-1 (IC$_{50}$=80.8±3.2 μM, FIG. 4D) despite less favorable macrodipole stabilization and diminished secondary structure (FIG. 4A). However, the β$^3$-hexapeptide β53-6 inhibited the p53AD$^{Flu}$·hDM2 interaction with an IC$_{50}$ of 36.2±2.6 μM, over 2-fold better than β53-1 and β53-5. A sequence-unrelated β$^3$-tetrapeptide containing β$^3$W (β53-7) and β$^3$W itself were poor inhibitors (IC$_{50}$>1 mM). These data confirm that the structural and design elements incorporated into β53-1, β53-5 and β53-6 control their inhibitory potencies, which are only 15 to 40-fold lower than that of p53AD.

Example 3

Solution Structure of a β-peptide ligand for hDM2

Two-dimensional NMR spectroscopy was performed using 5 mM β53-1 in CD$_3$OH at 10° C. Previous circular dichroism and analytical ultracentrifugation experiments and the NMR linewidths observed herein are consistent with a monomeric, 14-helical structure for β53-1 under these conditions. The proton resonances of β53-1 were assigned unambiguously using TOCSY and natural abundance $^1$H-$^{13}$C HSQC spectra. ROESY experiments were then performed using mixing times of 200 ms, 350 ms, and 500 ms. The observed series of NH—C$_α$H ROEs confirmed the sequential assignment by providing a backbone "ROE walk." Three classes of medium range ROEs characterize a 14-helical conformation: those between H$_N$(i) and H$_β$(i+2), H$_N$(i) and H$_β$(i+3), and H$_α$(i) and H$_β$(i+3). All 20 potential medium-range interactions of this type were observed in the ROESY spectra of β53-1; in addition, 27 additional medium-range ROEs between side chains three positions apart were also observed. The large number of medium-range ROEs observed by NMR provides clear evidence for a high level of 14-helix structure in β53-1. 449 ROEs quantified using a 350 ms mixing time were subsequently assigned and integrated using SPARKY. Peak volumes were converted to 151 upper-limit distance constraints and used to perform simulated annealing torsional dynamics on 100 random starting configurations of β53-1 using DYANA. No constraint violations were reported among the resulting 20 lowest-energy structures.

The ensemble of calculated structures of β53-1 shows a 14-helix with an average backbone atom RMSD from the mean structure of 0.17±0.07 Å. The backbone torsions of individual structures deviate little from the mean, even at the termini, illustrating the robustness of the β53-1 14-helix in methanol. The helix is characterized by approximately 1.61 Å rise per residue and 3.0 residues per turn for residues 1-6, with a slight unwinding to approximately 1.49 Å rise per residue and 3.3 residues per turn for residues 7-10. This unwinding appears unique to β53-1, as it was not observed in NMR structures of unrelated β$^3$-peptides with and without side chain ion pairing. Side chains are also well-defined among the lowest-energy structures, with an overall average heavy atom RMSD from the mean of 0.60±0.10 Å.

β53-1 contains four charged side chains arranged to favor formation of helix-stabilizing salt bridges on one 14-helix face. In all 20 low energy structures, the terminal nitrogen of β$^3$O7 and the nearest terminal oxygen of β$^3$E10 are characterized by a consistent separation of 5.5±0.6 Å. The relative positions of the remaining two ion pairs fall into two subpopulations. In 17 structures, the terminal nitrogen of β$^3$O1 and the nearest terminal oxygen of β$^3$E4 are closer (5.4±0.9 Å) than the equivalent atoms of β$^3$E4 and β$^3$O7 (6.8±0.9 Å). By contrast, in the remaining 3 structures, the terminal nitrogen of β$^3$O7 and the nearest terminal oxygen of β$^3$E4 are closer (3.6±0.4 Å) than the equivalent atoms of β$^3$O1 and β$^3$E4 (7.7±1.3 Å). This interplay among potential ion pairs suggests that the central salt bridge is weaker than those near the termini, and supports the hypothesis that multiple interconnected ion pairs play a key helix-stabilizing role.

Another feature incorporated into the design of β53-1 was the inclusion of β$^3$-homovaline (β$^3$V) residues at positions 2, 5, and 8. All 20 low energy structures contain a unique arrangement of β$^3$-homovaline side chains in which one methyl group of a β$^3$V side chain nestles into a cleft formed by the two methyl groups of another β$^3$V side chain. These interactions are especially noticeable between the side chains of β$^3$V5 and β$^3$V8, which are in VDW contact in 19 of 20 structures. Overall, interactions among the three β$^3$V side chains bury 155±13 Å$^2$ of hydrophobic surface area from water (24% of the surfaces of these side chains). These packing interactions may explain why these and other branched residues stabilize 14-helices, and suggest new avenues for the design of 14-helix bundles.

The remaining 14-helix face consists of residues that comprise the hDM2-binding epitope, namely β$^3$-homoleucine (β³L3), β³-homotryptophan (β³W6), and β³-homophenylalanine (β³F9). The β³F9 side chain can access two specific conformations within the constraints used; the fact that this variability has been observed in another 14-helix structure implies that the side chain may indeed preferentially populate these rotamers within a 14-helix. The side chains of β³W6 and β³L3 are in VDW contact in all 20 structures, while the side chains of β³W6 and β³F9 are in VDW contact in the context of only one of β³F9's two preferred conformations (present in 6 of 20 low energy structures). Overall, on average the side chains of β³L3, β³W6, and β³F9 comprise a continuous, solvent-exposed hydrophobic surface area of 520 Å². This value is comparable to the contact areas measured at the interfaces of transient homo- and heterodimeric protein complexes.

As a consequence of the unexpected unwinding near the C-terminus of β53-1, the β³F9 side chain is not aligned perfectly with the side chains of β³L3 and β³W6 along the helix axis. This subtle distortion may avoid steric repulsions between the large side chains of β³F9 and β³W6. In fact, it is unclear whether the unwinding near the C-terminus, which is unique to β53-1, is due to more favorable ion pairing, more favorable β³V nesting interactions, or the need to avoid steric clashes on the recognition face containing large hydrophobic residues Importantly, this subtle distortion allows the side chains comprising the β53-1 recognition face to better mimic those on the p53AD α-helix. Overlays between β53-1 in an idealized 14-helical conformation and p53AD bound to hDM2[23] revealed an imperfect alignment between the two ligands; while the β³L3, β³W6, and β³F9 side chains of β53-1 could superimpose with their counterparts on p53AD, the 14-helix backbone could not completely fit within hDM2's binding groove. The comparable overlay with the solution structure of β53-1 shows no such conflict. In its solution conformation β53-1 can access all three of hDM2's hydrophobic pockets while occupying the same binding groove as p53AD with no steric clashes.

This fit demands subtle unwinding near the β53-1 C-terminus that staggers the side chains, producing a β³-peptide that is uniquely suited for α-helix mimicry. Protein-protein interactions are notoriously difficult to inhibit with most ligand classes; the solution structure of β53-1 suggests that β-peptide oligomers can present an extended, highly variable surface that could be used as a general platform to target these critical interfaces.

Example 4

Effects of Conformational Restriction on a Helical β-peptide ligand for hDM2

Figure 5:
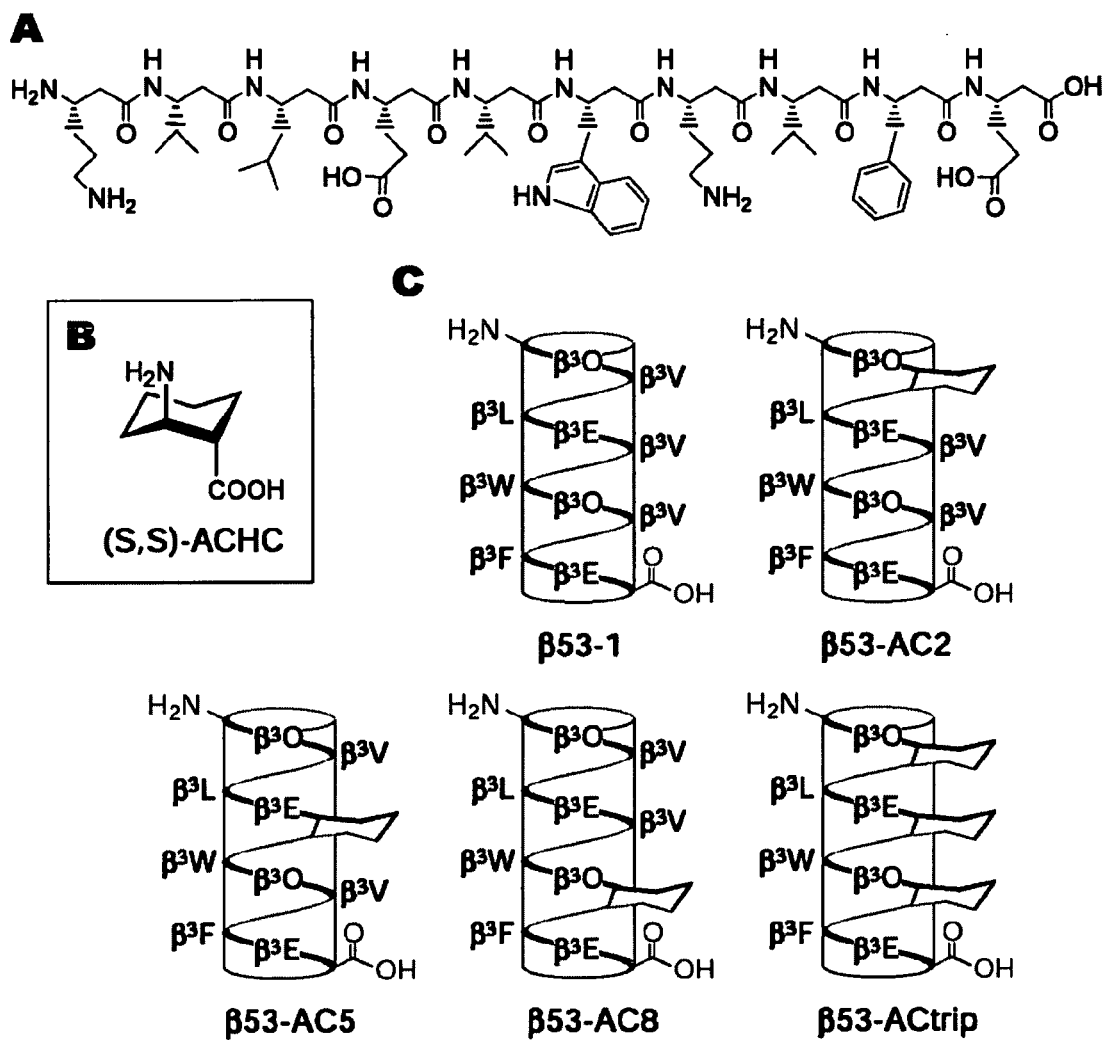
FIG. 5 shows (A) the chemical structure of $\beta$53-1, (B) trans-(S,S)-2-cyclohexaneamino acid, or ACHC, and (C) helical net diagrams of $\beta$53-1 and its ACHC-containing variants. $\beta^3$X denotes a $\beta^3$-amino acid with a side chain identical to that of the $\alpha$-amino acid with the one-letter abbreviation X. A six-membered ring denotes ACHC.

Four β53-1 variants were synthesized that include one or more residues of trans-(S,S)-2-aminocyclohexanecarboxylic acid (ACHC, FIG. 5B), which promotes left-handed 14-helix structure by constraining the central C-C backbone torsion within a cyclohexane ring. β-amino acid synthesis and β-peptide preparation were performed as previously described. Three of the β53-1 variants possess ACHC in place of a single β³-homovaline residue β53-AC2, β53-AC5, and β53-AC8 (Compounds 44-46) (SEQ ID NOS: 47-48), substituted at the 2, 5, and 8 position, respectively) and the fourth, β53-ACtrip (Compound 47) (SEQ ID NO: 50), possesses ACHC in place of all three β³-homovaline residues (FIG. 5C).

Figure 6:
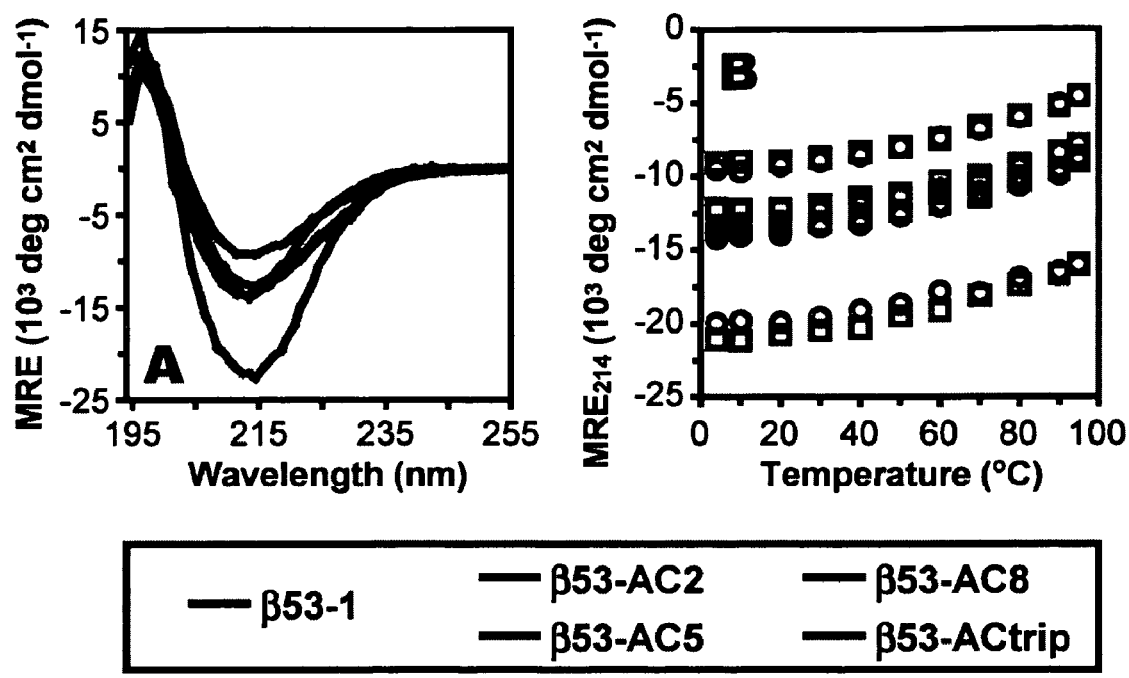
FIG. 6 shows the circular dichroism analysis of $\beta$53-1 and its ACHC-containing variants. (A) CD spectra of 80 μM $\beta$-peptide at 25° C., plotted as mean residue ellipticity (MRE). (B) MRE at 214 nm of 80 μM $\beta$-peptides at temperatures increasing linearly from 4° C. to 95° C. (circles), then decreasing linearly from 95° C. to 4° C. (squares). All CD measurements were acquired on samples prepared in 1 mM sodium phosphate/borate/citrate buffer, pH 7.0.

The ACHC-containing β-peptides were characterized by CD spectroscopy to examine their secondary structure. Incorporation of ACHC within a β³-peptide typically increases the intensity of the 14-helix CD signature (particularly the characteristic mean residue ellipticity minimum near 214 nm), implying increased structure. β53-1 and its variants are no exception (FIG. 6A). Interestingly, incorporating a single ACHC residue increases intensity of the minimum by 40-50% independent of position. Incorporation of three ACHC residues increases the intensity of the minimum in a purely additive fashion, leading to an overall 245% increase over β53-1. CD-based thermal denaturation analysis of β53-1 and its ACHC-containing variants (FIG. 6B) reveals reversible 14-helix unfolding, with no other detectable secondary structure at any temperature. Intriguingly, even at 98° C. β53-1 and its constrained variants show characteristic 14-helical CD signatures with minima at 214 nm at 45-75% of the intensity at 4° C. This effect is not seen when unfolding 14-helices by other means, such as neutralization of the stabilizing salt bridges by extremes of pH or high salt. Thus, the persistence of the 14-helix signature at high temperatures may indicate extraordinary thermostability within this series of 14-helices. The CD data as a whole support a model in which 14-helix folding is noncooperative and vastly more temperature-stable than α-helix folding. In agreement with this model, it was found that overall extents of helix formation in water by variants of β53-1 are dependent on the proportion, but not location, of conformationally constrained residues.

Next, the ACHC-containing β-peptides were characterized in terms of their affinities for hDM2 and their potencies in inhibiting the β53AD·hDM2 interaction. Fluorescein-conjugated versions of the ACHC-containing β-peptides were incubated with various concentrations of hDM2$_{1-188}$ and monitored by fluorescence polarization (FP) to detect binding, as described above. A FP competition assay in which various concentrations of unlabeled β-peptide was incubated with p$_{53}$AD$_{15-31}^{Flu}$ and hDM2$_{1-188}$ was employed to measure the β-peptides' inhibitory potencies, as described above. Apparent equilibrium dissociation constants ($K_d$'s) and half-maximal inhibitory concentrations (IC$_{50}$'s) derived from the FP data are summarized in Table 1. Incorporation of a single ACHC residue as in β53-AC2, β53-AC5, and β53-AC8 marginally increases apparent hDM2 affinity. The position-independent nature of this increase and the nearly identical CD spectra of β53-AC2, β53-AC5, and β53-AC8 imply that this effect stems from an increase in overall extent of structure and not on local changes in geometry. Compared to β53-1, all ACHC-containing variants are more potent inhibitors of the p53AD·hDM2 interaction. However, β53-AC5 appears to be a slightly poorer inhibitor than the other three. This may be due to possible self-association of this peptide at high concentrations (as described below). Importantly, the fact that incorporation of ACHC at any of several positions within β53-1 slightly improves apparent binding affinity implies that β53-1 and its variants bind hDM2 in a 14-helical conformation.

TABLE 1

| Ligand | $K_d$, μM[a] | IC$_{50}$, μM[b] |
|---|---|---|
| p53AD$_{15-31}$ | 0.23 ± 0.03 | 2.5 ± 0.1 |
| β53-1 | 0.37 ± 0.08 | 94.5 ± 4.4 |
| β53-AC2 | 0.21 ± 0.04 | 15.5 ± 1.0 |
| β53-AC5 | 0.21 ± 0.04 | 60.3 ± 3.8 |
| β53-AC8 | 0.22 ± 0.06 | 10.5 ± 0.8 |
| β53-ACtrip | 0.17 ± 0.05 | 17.2 ± 1.3 |

[a]Apparent equilibrium dissociation constants ($K_d$) of complexes between fluorescein-labeled ligands and hDM2.
[b]Concentration of unlabeled ligand needed to inhibit by 50% (IC$_{50}$) the fraction of p53AD$_{15-31}^{Flu}$ bound to hDM2$_{1-188}$.

β53-ACtrip, the most constrained β-peptide in this study, possesses the same marginal improvements in apparent affinity and inhibitory potency as the variants with a single constrained residue. This indicates that a highly rigidified 14-helix does not perfectly mimic β53AD's α-helix. However, distortions in the 14-helix backbone, as have been observed for β53-1 in methanol, may render a short, unconstrained 14-helix more α-helix-like in shape and in positioning of side chains. While ACHC incorporation should stabilize the overall 14-helix conformation, it locks the central C—C torsion to 60°, which deviates significantly from the values observed for positions 5 and 8 within the β53-1 methanol solution structure (64.8±5.9°, 41.9±3.7° and 78.1±4.0° for C—C torsion angles at positions 2, 5, and 8 respectively).[2] Thus, ACHC likely induces local and/or global changes in conformation relative to β53-1's preferred solution structure. The present results seem to indicate a trade-off inherent in ACHC incorporation: while the overall fold may be stabilized, important features of local conformation that account for hDM2 recognition may be altered.

Analytical ultracentrifligation (AU) is commonly used to determine whether peptides and proteins oligomerize and to estimate the nature of the self-association equilibrium. Previously, AU had shown that β53-1 is monomeric at concentrations exceeding 1 mM. The ACHC-containing β53-1 variants were all analyzed by AU as described previously. β53-AC2 showed no evidence of oligomerization, while β53-AC8 showed slight curvature in the radial distance data that could indicate a monomer-dimer equilibrium at low millimolar concentrations. By contrast, β53-AC5 and β53-ACtrip showed striking gaps in the radial distance data, with curvatures consistent with formation of discrete higher-order oligomers, likely hexamers or heptamers. Both data sets suggested apparent $K_d$'s for oligomer dissociation in the 100 to 500 μM range. Self-association by ACHC-containing β-peptides has been previously detected by AU and by NMR. The current data highlight the exquisite sensitivity of 14-helix self-assembly to the presence and placement of conformationally constrained residues.

The results presented herein demonstrate that conformational restriction can marginally increase the apparent in vitro affinity and inhibitory potency of a β-peptidic protein ligand. However, the results also show that that there may be limits to the benefits of conformational restriction for development of 14-helical α-peptide mimics. In addition, the results provide evidence that β53-1 and its variants unfold noncooperatively and reversibly, and bind hDM2 in a 14-helix conformation. The data as whole validate the design strategy whereby residues on three successive turns of an α-helix can be mimicked by a 14-helical β-peptide.

Example 5

Protein Ligands with Nanomolar Affinity from β-Peptide Libraries

Previous reports have documented significantly reduced yields during the synthesis of β-peptide oligomers longer than hexamers. To overcome this obstacle, the time of the coupling cycle was increased and each residue was coupled twice. A second deprotection step was included in which residual Fmoc groups were removed. Pools of 100-200 beads from non-library syntheses were cleaved from the resin and tested by analytical HPLC to assess purity, and of the syntheses tested in this way, over 50% were at least 80% pure, and over 75% were at least 70% pure. In addition, MALDI mass spectra obtained from material cleaved from single split-and-pool library beads showed a single major product in the expected mass range over 95% of the time. The synthesis quality matches or exceeds those of previously reported peptoid and oligocarbamate libraries.

Figure 7:
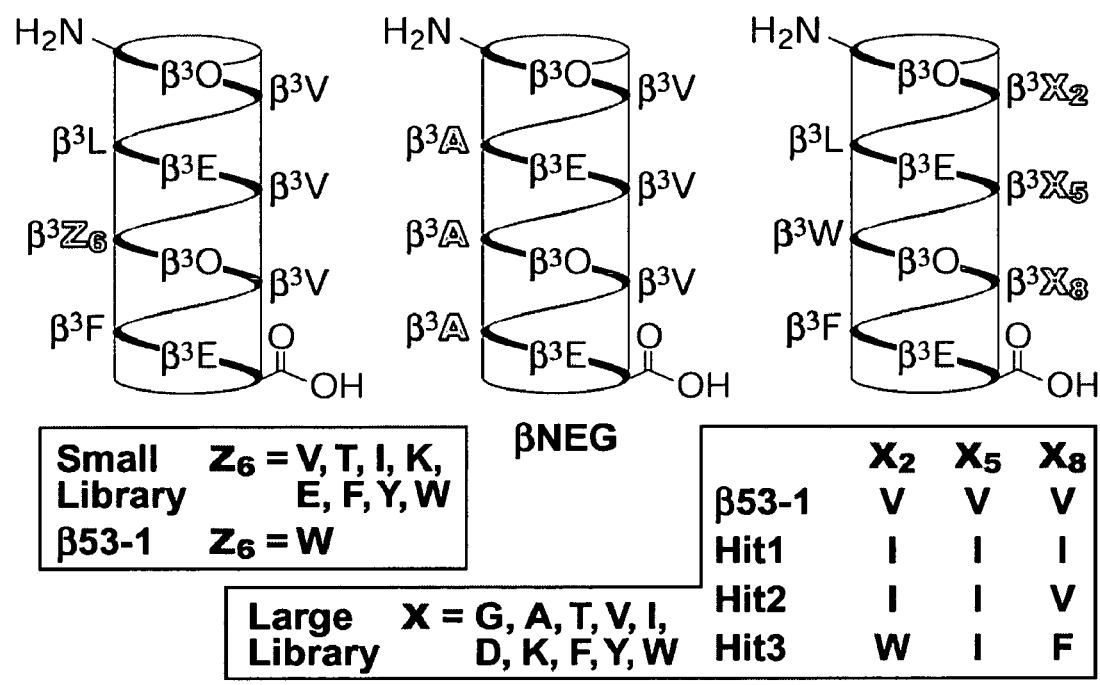
FIG. 7 shows helix diagrams of 53-1, $\beta$NEG, the small library, the large library, and hits 1-3, as described in Example 5.

Using the refined synthesis protocol, β53-1 and βNEG (FIG. 7) were synthesized on Tentagel macrobeads (~150 μm, ~0.4 mmol/g) as positive and negative controls, respectively. A 4-hydroxymethylbenzoic acid (HMBA) handle was employed, which allows for side chain deprotection under standard acidic conditions, then later cleavage of the peptide using 1 M sodium methoxide in methanol. The on-bead purities of these β-peptides were 90% and 80%, respectively, as judged by analytical HPLC (data not shown). As reported by Kodadek and coworkers (*Chembiochem* 4(11): 1242-1245 (2003)), quantum dots, with their enormous Stokes shifts, provide simple secondary detection of bound protein and enable discrimination of hits based on color rather than intensity. By using biotinylated $hDM2_{1-188}$ and streptavidin-coated quantum dots in a two-step detection, it was possible to use an excitation wavelength to distinguish quantum dot fluorescence (which, with an emission maximum of 605 nm, appeared orange) from bead autofluorescence (which appeared green). Blocking and washing conditions were optimized to generate robust signals for β53-1 beads that were not present on βNEG beads. Notably, increasing concentrations of blocking protein, salt, and/or detergent each attenuated the intensity of the resulting signals. Controls in which unbiotinylated $hDM2_{1-188}$, biotinylated BSA, unbiotinylated BSA, or no protein were used in place of the biotin-$hDM2_{1-188}$ showed no binding of quantum dots to the beads, demonstrating that the assay detects specific binding between the bead-bound β-peptide and the target protein $hDM2_{1-188}$.

To test the assay, a small library composed of eight members (Compounds 48-55, FIG. 7) (SEQ ID NO: 51-58) was evaluated. The library consisted of β53-1 variants with eight different $β^3$-amino acids substituted for the critical $β^3$-homotryptophan at position 6. At the re-pooling step following coupling 6, small pools of each individual library member were retained and each synthesis completed in order to have the individual library members for separate testing. When these pools were assayed individually, signals were observed that scaled roughly with size and hydrophobicity of the side chain in position 6. Thus, the brightest signals were observed from the pools with the original $β^3$-homotryptophan or a $β^3$-homotyrosine residue at position 6. When the library was assayed under identical conditions, various signal intensities from no signal to very bright were observed, consistent with the intensity range observed for the separated library members.

Next, mock screens were performed to determine whether Applicants could pick hits, cleave β-peptides from individual beads and use mass spectrometry to sequence the cleaved β-peptides. High-intensity and low-intensity beads were picked from the 8-member library screen for testing. Also, five β53-1 beads were added to a vast excess (>1000) of βNEG beads, and this pool was assayed as well (ref SI). A bright bead from this screen was also picked for testing.

Individual beads were washed, cleaved, and desalted. MALDI spectra were obtained using less than 5% of the cleaved material, and generated clean spectra with a single major product. MS/MS spectra were obtained using 20-80% of the remaining product, highlighting the ease with which high-quality mass spectral data is obtained from β-peptides cleaved from individual beads. Sequencing results confirmed the utility of the assay: the high-intensity bead picked from the 8-member library screen had $β^3$-homotyrosine in the sixth position, the low-intensity bead picked from the 8-member library screen had β³-homoglutamic acid in the sixth position, and the bright bead picked from an excess of βNEG beads was identified as β53-1.

To further evaluate the assay, a larger library with 1,000 members was synthesized (Compounds 56-1055, FIG. 7) (SEQ ID NOS: 59-1058). This library replaced each β³-homovaline residue in β53-1 (positions 2, 5, and 8) with one of ten β³-amino acids. The library varies the only face with no proven function, since the other two faces provide helix stabilization and hDM2 recognition. Further, the NMR solution structure of β53-1 in methanol shows that the β³-homovalines interact most favorably when the 14-helix is distorted, making the presentation of the recognition face more like that of an α-helix.

First, the library was screened using similar conditions as in the small library. In this screen, 25 beads were picked from ~8,000, a hit ratio of 0.3%. MALDI and MS/MS spectra confirmed that these represented at least 10 different sequences. The screen was re-performed with less target protein and more stringent washing steps, in an effort to lower the proportion of hits. The second screen yielded 35 hits from ~16,000 beads, a hit ratio of 0.2%, with much lower signal among non-hit beads. MALDI and MS/MS spectra confirmed that these 35 beads represented only three different sequences: Hit1 (16 beads), Hit2 (18 beads), and Hit3 (1 bead). Significantly, each of these hits was identified multiple times among the 25 hits culled from the first screen, confirming that increased washing had narrowed the field of hits considerably.

Figure 8:
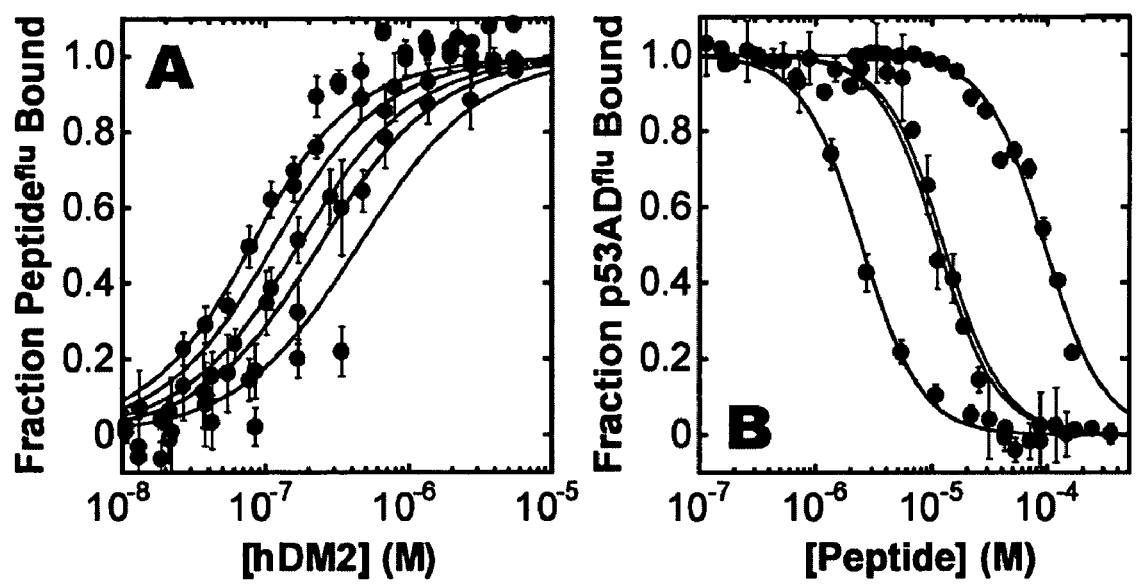
FIG. 8 shows (A) FP binding data and curve fits for incubation of varying concentrations of hDM2$_{1-188}$ with 25 nM dye-labeled peptide: p$_{53}$AD$_{15-31}^{flu}$, $\beta$53-1$^{flu}$, Hit1$^{flu}$, HIT2$^{flu}$, or Hit3$^{flu}$; and (B) FP competition data and curve fits for incubation of 0.5 μM hDM2$_{1-188}$ with 25 nM p53AD$_{15-31}^{flu}$ and varying concentrations of: p53AD$_{15-31}$, $\beta$53-1, Hit1, or Hit2.

The three hits (sequences in FIG. 7) were synthesized and characterized as described above. Specifically, their overall secondary structure was estimated by CD spectroscopy, their hDM2 affinity was measured by using a fluorescein-labeled variant in a fluorescence polarization (FP) assay with hDM2 (FIG. 8A), and their potency for inhibition of the p53AD$_{15-31}$$^{flu}$·hDM2$_{1-188}$ interaction was measured in a competition FP assay (FIG. 8B). Hits 1 and 2 are particularly potent, with binding affinities ($K_d$'s) of 55±8 nM and 89±20 nM, respectively, and inhibitory potencies (IC$_{50}$'s) of 13±1 and 11±1 μM, respectively.

In sum, Applicants have developed a method for synthesizing and screening large β-peptide OBOC libraries. The techniques for synthesis, screening, and decoding are all highly scalable, through the use of fluorescence-based bead sorters, high-throughput mass spectrometry, and de novo peptide sequencing algorithms. The assay signal can be tuned in multiple ways to achieve a desired hit rate, which should allow for rapid discovery of low affinity ligands for a wide variety of protein targets, as well as subsequent refinement of those hits into nanomolar affinity ligands.

Example 6

Figure 9:
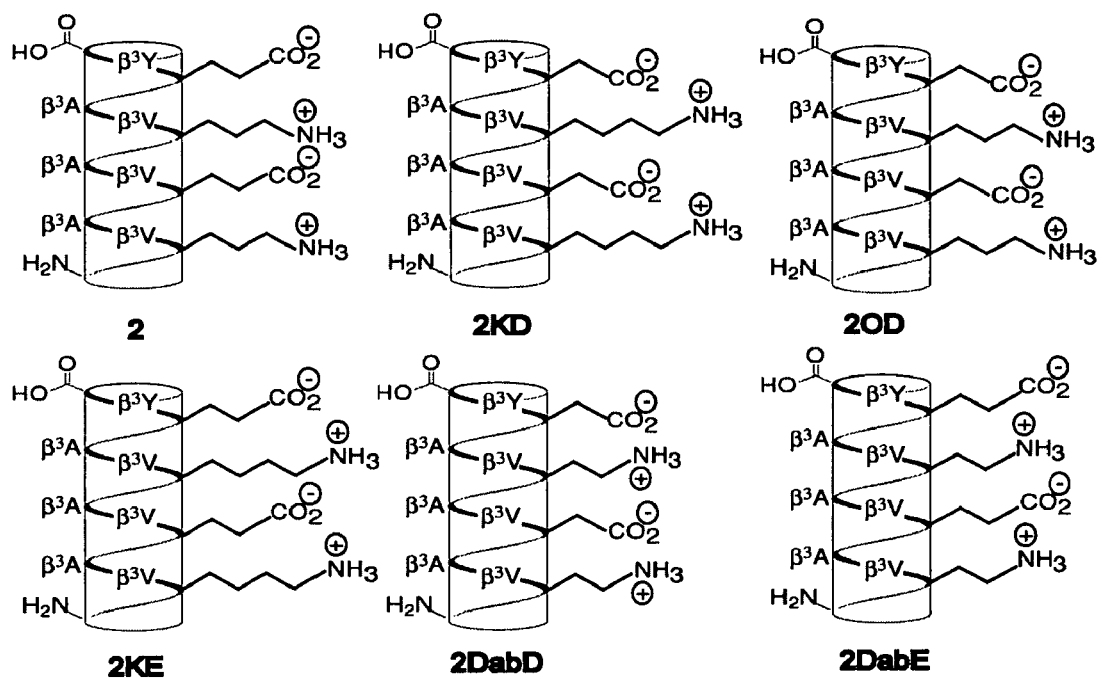
FIG. 9 shows helical net diagrams of $\beta^3$-peptides evaluated in Example 6.

Effects of Systematic Salt-bridge Residue Substitutions on β³-peptide 14-Helical Character A set of six β-dodecamers were studied to evaluate the effect of charged side chain length on 14-helix stability in water (FIG. 9). All six molecules contain helix-promoting aliphatic β³-homovaline residues at positions 2, 5, 8, and 11 along one face of the putative 14-helix, β³-homoalanine residues at positions 3, 6, and 9 along a second face, and a vareity of different acidic and basic side chains at positions 1, 4, 7, and 10. Each molecule also carried a single β³-homotyrosine residue to simplify spectrophotometric determination of β-peptide concentration. The β³-peptides were synthesized using automated or manual solid phase methods, purified using reverse phase HPLC, and their sequences confirmed using MALDI-TOF mass spectrometry. All six molecules are monomeric as determined by analytical ultracentrifugation.

Figure 10:
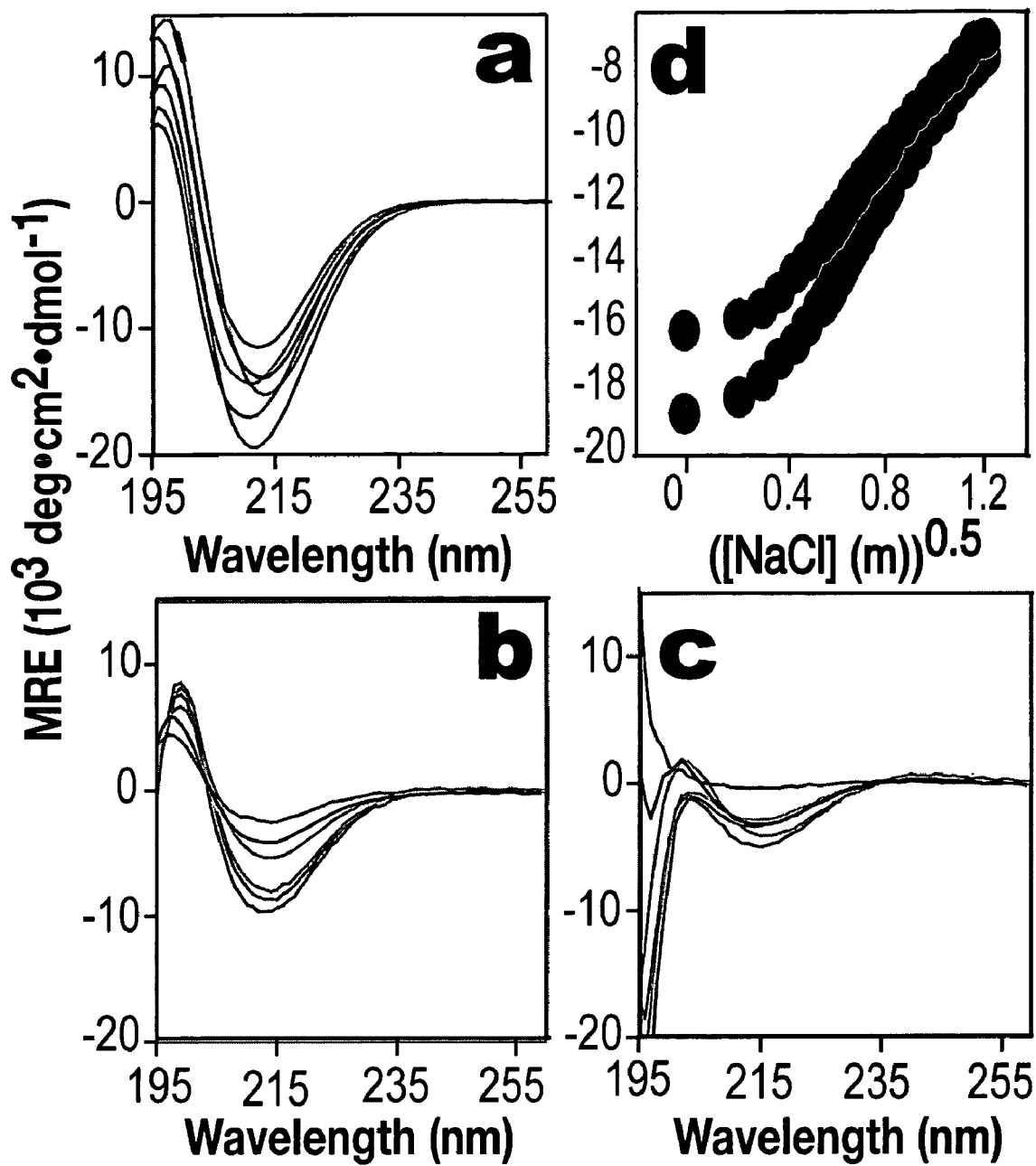
FIG. 10 shows CD spectra of 2, 2KE, 20D, 2KD, 2DabD, and 2DabE (100 μM $\beta$-peptide, PBC buffer, 25° C.) at: (A) pH 7.0 (B) pH 2.0 (C) pH 12.0; and (D) a plot of MRE$_{214}$ of 100 μM 2DabE and 2DabD as a function of the NaCl concentration (pH 7.0, 25° C.).

Circular dichroism (CD) spectroscopy was used to characterize the extent of 14-helix structure in each β-peptide at 80 μM and 25 °C. While CD data on β-peptides must be interpreted carefully, it is reasonable to assume that for β³-peptides in particular, changes in intensity of the 14-helical signature correlate to relative changes in overall mean 14-helical population. The CD spectra of all six molecules are consistent with a 14-helix structure, with ellipticity minima between 211-214 nm, ellipticity maxima between 195-198 nm, and a cross-over between negative and positive ellipticity between 200-202 nm (FIG. 10A, Table 2). Despite the overall similarity of the CD curves, the maximal values of negative ellipticity differed dramatically among the six molecules, ranging from a low of −11,537 deg·cm²·dmol$^{-1}$ to a high of −19,451 deg cm² dmol$^{-1}$. These differences represent changes of more than 40%. Overall the molecules can be ordered with regard to overall 14-helix structure, from greatest to least: 2DabD (Compound 1056) (SEQ ID NO: 1059)>2OD (Compound 1057) (SEQ ID NO: 1060)>2DabE (Compound 1058) (SEQ ID NO: 1061)>2KD (Compound 1059) (SEQ ID NO: 1062)>2>2KE (Compound 1060). In general, otherwise identical molecules containing β³-homoaspartic acid display higher levels of 14-helix structure than molecules containing β³-homoglutamic acid (β³-Glu). Molecules containing β³-aminomethylalanine have greater 14-helical character than otherwise identical molecules containing β³-homoornithine which are, in turn, more helical than identical molecules containing β³-Glu. These data suggest that subtle differences in electrostatic components introduce small changes in the overall amount of 14-helix structure. More specifically, these results suggest that 14-helical character increases as the length of the side chain decreases.

TABLE 2

| MRE (deg cm² dmol$^{-1}$ residue$^{-1}$) for CD trials in 1× PBC, 25° C. | | | | |
|---|---|---|---|---|
| −θ$_{min}$ (pH 7) | −θ$_{min}$ (pH 2) | −θ$_{min}$ (pH 12) | % Δ (pH 2/7) | % Δ (pH 12/7) |

| | −θ$_{min}$ (pH 7) | −θ$_{min}$ (pH 2) | −θ$_{min}$ (pH 12) | % Δ (pH 2/7) | % Δ (pH 12/7) |
|---|---|---|---|---|---|
| 2DabD | 19,451 | 9,687 | 4,965 | 50 | 74 |
| 2OD | 17,052 | 8,711 | 3,370 | 49 | 80 |
| 2DabE | 15,245 | 5,351 | 4,114 | 65 | 73 |
| 2KD | 14,438 | 8,043 | 2,879 | 44 | 80 |
| 2 | 13,947 | 4,130 | 3,191 | 70 | 77 |
| 2KE | 11,537 | 2,572 | 376 | 78 | 97 |

To provide evidence that ion pair formation contributed to the differences in stability among these β-peptides, their CD spectra at pH 7 were compared to those measured at pH 2 and 12. In each case, altering the pH from neutrality led to significant decreases (between 44 and 97%) in mean residue ellipticity (MRE) between 211 and 215 nm (FIG. 10B,C, Table 2). In general, larger pH-dependent changes were observed in peptides possessing lower levels of 14-helix structure as judged by CD (2, 2KE) than with those possessing higher levels of 14-helix structure (2DabD, 2OD). Interestingly, in each case the decline in mean residue ellipticity was greater when the pH was raised to pH 12 than when it was lowered to pH 2. These results are, overall, consistent with previous studies of salt-bridge stabilized β-peptides, where precipitous decreases in mean residue ellipticity was observed at pH values above or below the pK$_a$ values expected for the relevant acidic and basic side chains, respectively. Overall, the data are consistent with an electrostatic mechanism of stabilization.

The ability of the most 14-helical β-peptide, 2DabD, to maintain the 14-helix was further examined by the titration of an electrolyte into solution at pH 7. For comparison, 2DabE, which possesses less initial 14-helix content, was also evaluated using increasing concentrations of sodium chloride. The resulting curves are approximately sigmoidal and indicate a midpoint around 0.5 M NaCl for both β-peptides (FIG. 10D). Previously described work by DeGrado et al indicated a midpoint of 0.4 M NaCl for β-peptides containing two faces of β³-Lys/β³-Glu salt-bridging with a C-terminal D-Asp cap. Therefore, β-peptides with only one face of shorter salt-bridging residues have shown increased structural stability in the presence of higher salt concentrations. 2DabD begins with a lower minimum MRE than 2DabE, reemphasizing more initial 14-helical content. Neither curve indicates that the β-peptides reach a completely unfolded state, although both curves appear to converge at high salt concentration. This observation supports a non-cooperative folding mode that implies other aspects of the structure beyond salt-bridging affect 14-helical character.

To evaluate whether the increase in 14-helix structure suggested by the CD data would be important in the context of a β-peptide of diverse sequence, an altered salt bridge was applied to the previously characterized β-peptide β53-1. In this experiment, the β³-Orn/β³-Glu salt bridge was replaced with β³-Orn/β³-Asp, creating β53-1D (Compound 1061) (SEQ ID NO: 1064). Based on the evidence from CD experimentation comparing 2 and 2OD, it was expected that the substitution would further stabilize the 14-helical structure of β53-1. An initial CD comparison of the two compounds showed that β53-1D was slightly more 14-helical than β53-1, with a mean residue ellipticity of −9564.19 deg·cm$^{2}$·dmol$^{-1}$ versus −8450.4 deg·cm$^{2}$·dmol$^{-1}$, respectively.

Two dimensional NMR spectroscopy of β53-1D in CD$_3$OH was perform to confirm the 14-helix structure and to compare the spectral patterns of β53-1D to β53-1. The ROESY spectra of β53-1D at 10° C. showed ten unambiguous ROEs characteristic of 14-helical structure: five of seven possible C$_\alpha$H(i)→C$_\beta$H(i+3) ROEs and five of six possible C$_N$H(i)→C$_\beta$H(i+3) ROEs. Additional backbone ROEs may be present but are obscured by resonance overlap. No backbone ROEs inconsistent with 14-helix structure were observed. The pattern of the ROESY spectrum for β53-1D closely matched that of β53-1, further supporting that β53-1D forms a 14-helix.

Interestingly, both TOCSY and aliphatic HSQC spectra indicated that vicinal protons in the γ position along both β³-Orn side chains were clearly resolved for β53-1D, but not for β53-1. This is evidence that there is a more rigid set of β³-Orn side chain conformations when it is paired with β³-Asp. In support of this, ROEs between the β³-Orn γ protons and i±3 protons associated with β³-Asp residues were sought. Particularly striking was a β proton of β³-Asp, residue four, appeared to have two ROEs with residue seven, β³-Orn γ proton 1 and γ proton 2. Overall, the NMR data implies a subtle increase in order to the side-chain structure as β³-Orn forms salt bridges to the shorter β³-Asp residue.

Next, the effects of changes in the salt bridge on the affinity of the ligand for protein target hDM2 were assessed. $^{Flu}$β53-1D, labelled N-terminally with fluorescein, was prepared to measure direct binding to hDM2$_{1-188}$ through a fluorescence polarization assay. A direct comparison was made to N-terminally fluorescein-labelled β53-1. $^{Flu}$β53-1D bound hDM2 with a K$_d$ of 370±69 nM while $^{Flu}$β53$_{-1}$ bound hDM2 with a K$_d$ of 368±76 nM. Clearly the change in the salt-bridge does not affect binding of the fluorescein labelled β-peptide ligands to the target protein. The K$_d$ for the activation domain of p53 binding hDM2 has been shown to equal 220±8 nM. Both β-peptide ligands have binding affinities about 1.7 times lower than that of the natural p53 activation domain. Despite increased structure, the β-peptide ligand showed no improvement in binding to hDM2. This may indicate that a trade-off exists between the benefit of pre-structured β-peptides and the level of necessary structural fluidity for 14-helical mimics of α-peptides.

In summary, these results provide evidence that forming salt bridges using residues with short, charged side chains can stabilize 14-helix structure in β³-peptides. In addition, the use of the β³-Orn/β³-Asp salt bridge in a functional β-peptide further increased its 14-helical character and had no negative consequence towards affinity to its protein target.

Example 7

Inhibition of HIV Fusion by a β-peptide Foldamer

Linear peptides derived from the HIV gp41 C-terminus (C-peptides), such as the 36-residue Fuzeon™, are potent HIV fusion inhibitors. These molecules bind to the N-peptide region of gp41 and act as dominant negative inhibitors of an intramolecular protein-protein interaction that powers fusion of the viral and host cell membranes. The HIV gp41 N-peptide region contains a shallow surface pocket that is less prone to mutation than other gp41 regions or HIV enzymes. This pocket is occupied in the post-fusion state by three α-helical residues found near the gp41 C-terminus: Trp628, Trp631, and Ile635 (FIG. 11A); together these residues comprise the WWI functional epitope. Simple and constrained α-peptides, aromatic foldamers, peptide-small molecule conjugates, and small molecules that bind this pocket inhibit gp41-mediated fusion.

Figure 11:
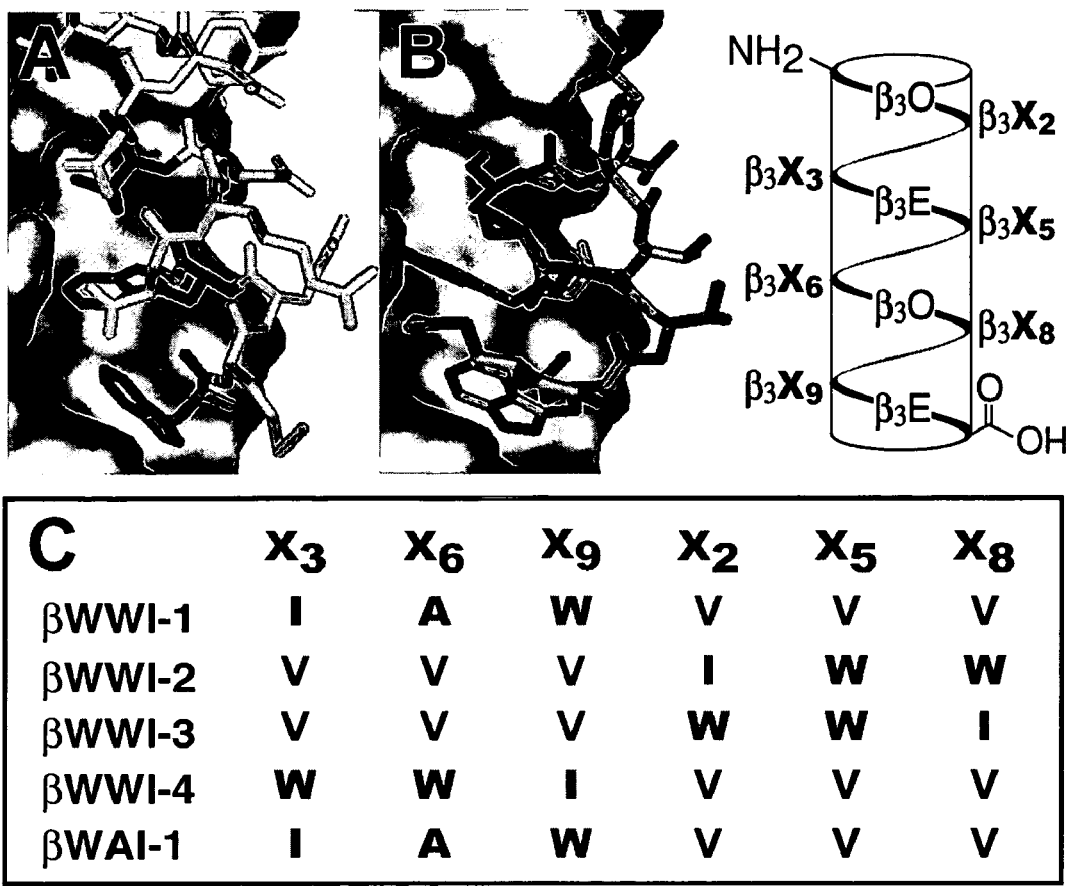
FIG. 11 shows (A) a close-up of the gp41 "trimer of hairpins" showing the WWI functional epitope nestled into a shallow groove on the surface of the internal trimer, (B) a model illustrating how interactions of the WWI functional epitope could be recapitulated by an appropriately substituted $\beta$-peptide 14-helix, and (C) sequences of $\beta^3$-peptides $\beta$WWI-1-4 and $\beta$WAI-1.
Figure 12:
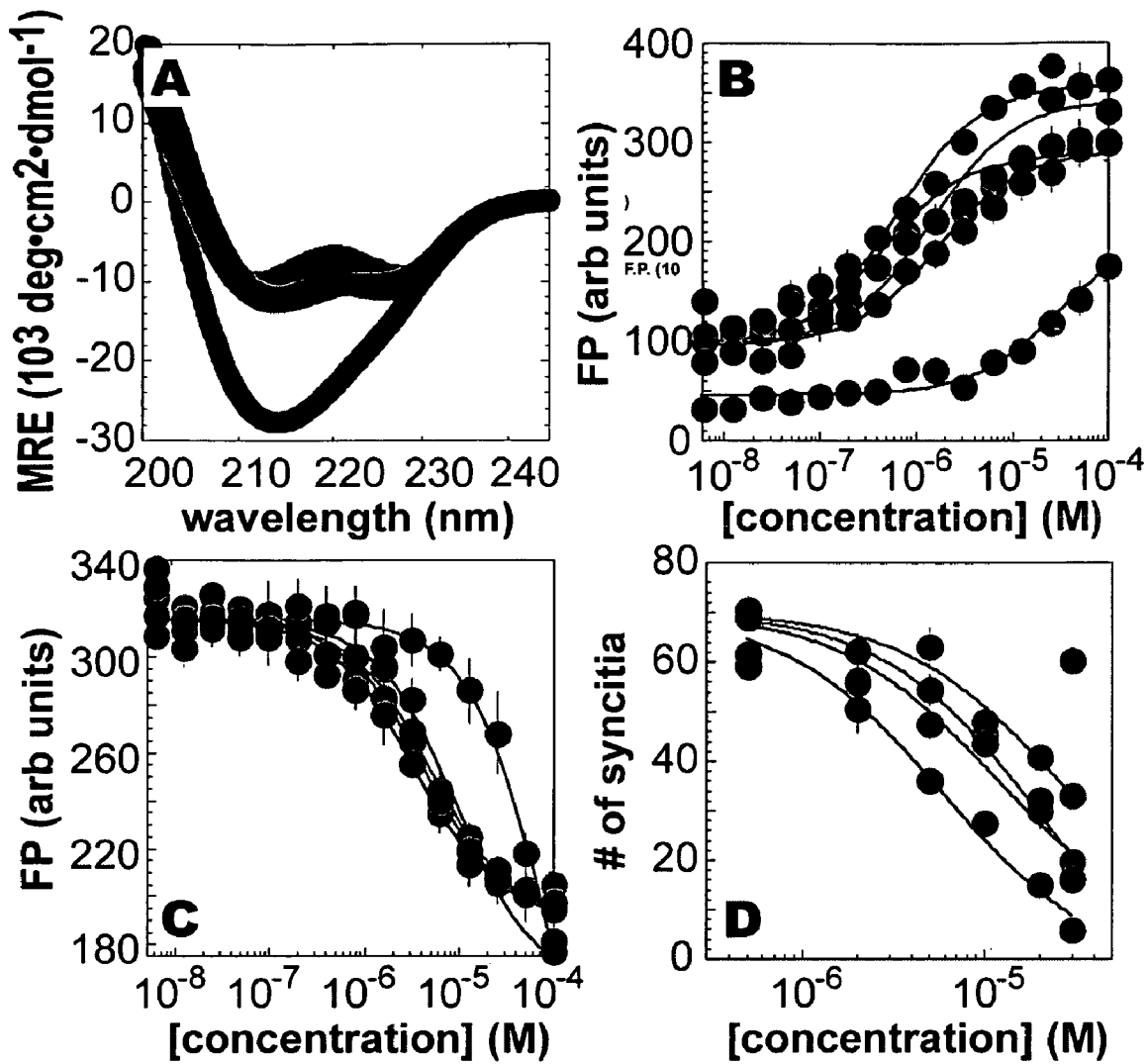
FIG. 12 shows (A) CD spectra of 37 μM $\beta$WWI-1-4 and $\beta$WAI-1 in PBC buffer (pH 7.0), (B) direct fluorescence polarization analysis of the binding of IZN17 by $\beta$WWI-1-4 and $\beta$WAI-1, where data shown represent the average of 3 experiments±the standard error, (C) inhibition of C14wt$^{Flu}$·IZN17 complexation by $\beta$WWI-1-4 and, $\beta$WAI-1, and (D) inhibition of syncitia formation by $\beta$WWI-1-4 and $\beta$WAI-1.

One goal of this experiment was to prepared a set of β-peptide decamers βWWI-1-4 in which the WWI epitope is presented on one face of a short 14-helix (FIG. 11B,C). Accordingly, four β³-peptides (βWWI-1-4, Compounds 1062-1065) (SEQ ID NO: 1065-1068) were synthesized in which the WWI epitope was presented in both orientations on each available face of a β³-decapeptide possessing significant 14-helix stability in aqueous solution due to electrostatic macrodipole stabilization and side chain-side chain salt bridges on one helical face. βWAI-1 was prepared as a control, as previous work has documented the significant contribution of the central tryptophan to gp41 affinity and viral infectivity. The circular dichroism spectra of βWWI-1-4 and βWAI-1, all of which exist as monomers at 50 μM concentration, display the expected minima at 214 nm (FIG. 12A). The spectra of βWWI-1-4, but not βWAI-1, also show a transition at 227 nm, which may result from distortions in the 14-helix or from the presence of two tryptophan residues in close proximity.

Each β-peptide was labeled at the N-terminus using the succinimidyl ester of Fluorescein-5-EX (Molecular Probes) and used in direct fluorescence polarization (FP) experiments to determine its affinity for the gp41 model IZN17. IZN17, which exists as a stable trimer in solution, contains 24 residues of a well-characterized isoleucine zipper fused in register to 17 residues from gp41 that contain the shallow receptor for the WWI functional epitope. All four β-peptides βWWI-1-4$^{Flu}$ bound IZN17 well, with equilibrium affinities of 0.75±0.1, 1.0±0.3, 2.4±0.7, and 1.5±0.4 μM, respectively (FIG. 12B). Interestingly, in this case, IZN17 affinity is relatively insensitive to the orientation of the WWI epitope relative to either the 14-helix macrodipole or the salt-bridging face. The affinity of βWWI-1-4 for gp41's hydrophobic pocket is nearly identical to that of the highest affinity α-peptide of comparable size ($K_d$ of 1.2 µM). Also, βWWI-1 binds IZN17 with significantly higher affinity than it binds carbonic anhydrase II ($K_d$ of ≧115 µM) or calmodulin ($K_d$ of ≧100 µM), two globular proteins known to recognize hydrophobic and/or helical molecules Two experiments were performed to investigate the binding mode of βWWI-1-4. First competition fluorescence polarization experiments were performed to assess whether βWWI-1-4 would compete with C14wt$^{Flu}$, a fluorescent analogue of a known gp41 ligand that binds IZN17 with an affinity of 4.1µM(suc-MTWMEWDREINNYTC$^{Flu}$-am (SEQ ID NO: 1)). βWWI-1-4 competed well, with IC$_{50}$ values of 4.0 ±0.7, 4.6 ±0.4, 13 ±4.1, and 3.3 ±1.4 µM respectively (FIG. 12C). An analog of βWWI-1 was synthesized, βWAI-1, containing alanine in place of the central tryptophan of the WWI epitope. βWAI-1$^{Flu}$ bound IZN17 with far lower affinity ($K_d$>20 µM) than βWWI-1 and βWAI-1 competed poorly with C14wt$^{Flu}$ for IZN17 binding (IC$_{50}$ of 72.9±5.0 M). Taken together, these data suggest that the affinity of βWWI-1-4 for IZN17 results from specific interactions with the WWI epitope.

β$^3$-peptides βWWI-1-4 were then evaluated for their ability to inhibit gp41 mediated fusion in a validated cell-fusion assay that accurately predicts inhibitory potency in HIV infectivity assays. This assay makes use of HeLa-CD4-LTR-β-gal cells that express CD4+ and β-galactosidase in the presence of the HIV-1 tat protein and CHO-SEC cells that express HIV-1 env, tat, and rev. In the absence of inhibitors, these cells fuse and form syncitia that express β-galactosidase and can be detected by staining with 5-bromo-4-chloro-3-indoyl-β-D-galactocide. All four β-peptides βWWI-1-4 inhibited cell-cell-fusion in this assay with EC$_{50}$ values of 27±2.5, 15±1.6, 13±1.9, and 5.3±0.5 µM, respectively (FIG. 12D). These EC$_{50}$ values are equal if not better than to those obtained using constrained and cyclic D-peptides (35 µM and 3.6 µM, respectively), polyaromatic foldamers (31 µM), peptide-small molecule conjugates (0.3 µM) or small molecules (7.3, 10, and 4.4 µM). Although still significantly less potent than Fuzeon™ (IC$_{50}$=0.11 nM), these first generation β-peptide fusion inhibitors are one-third the size of Fuzeon™, metabolically stable, and can be optimized by newly developed combinatorial methods.

In summary, these results provide evidence that short β-peptide 14-helices can function as effective inhibitors of an intramolecular protein-protein interaction in vivo. βWWI-1-4 bind selectively to a validated gp41 model in vitro and inhibit viral fusion in cell culture.

INCORPORATION BY REFERENCE

All publications and patents mentioned herein are hereby incorporated by reference in their entirety as if each individual publication or patent was specifically and individually indicated to be incorporated by reference.

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations.

SEQUENCE LISTING (1068 sequences)

SEQ ID NO: 1 - protein, 15 aa, Artificial Sequence
  Synthetic Peptide
  MISC_FEATURE (1)..(1): Suc
  MISC_FEATURE (15)..(15): Am
  MISC_FEATURE (15)..(15): Flu
MTWMEWDREINNYTC

SEQ ID NO: 2 - protein, 11 aa, Artificial Sequence
  Synthetic Peptide
  SITE (1)..(1): Beta-Ornithine
  SITE (2)..(2): Beta-Tyrosine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXXG

SEQ ID NO: 3 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 4 - protein, 11 aa, Artificial Sequence
  Synthetic Peptide
  SITE (1)..(1): Beta-Ornithine
  SITE (2)..(2): Beta-Valine
  SITE (3)..(3): Beta-Lysine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 5 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Lysine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 6 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Lysine
  SITE (10)..(10): Beta-Glutamic Acid
  SITE (11)..(11): Beta-Tyrosine
XXXXXXXXXXX

SEQ ID NO: 7 - protein, 11 aa, Artificial Sequence
  Synthetic Peptide
  SITE (1)..(1): Beta-Ornithine
  SITE (2)..(2): Beta-Valine
  SITE (3)..(3): Beta-Glutamic Acid
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 8 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Glutamic Acid
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 9 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Glutamic Acid
  SITE (10)..(10): Beta-Glutamic Acid
  SITE (11)..(11): Beta-Tyrosine
XXXXXXXXXXX

SEQ ID NO: 10 - protein, 11 aa, Artificial Sequence
  Synthetic Peptide
  SITE (1)..(1): Beta-Ornithine
  SITE (2)..(2): Beta-Valine
  SITE (3)..(3): Beta-Valine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 11 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Valine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 12 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Valine
  SITE (10)..(10): Beta-Glutamic Acid
  SITE (11)..(11): Beta-Tyrosine
XXXXXXXXXXX

SEQ ID NO: 13 - protein, 11 aa, Artificial Sequence
  Synthetic Peptide
  SITE (1)..(1): Beta-Ornithine
  SITE (2)..(2): Beta-Valine
  SITE (3)..(3): Beta-Isoleucine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 14 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Isoleucine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 15 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Isoleucine
  SITE (10)..(10): Beta-Glutamic Acid
  SITE (11)..(11): Beta-Tyrosine
XXXXXXXXXXX

SEQ ID NO: 16 - protein, 11 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 17 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Leucine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 18 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Leucine
  SITE (10)..(10): Beta-Glutamic Acid
  SITE (11)..(11): Beta-Tyrosine
XXXXXXXXXXX

SEQ ID NO: 19 - protein, 11 aa, Artificial Sequence
  Synthetic Peptide
  SITE (1)..(1): Beta-Ornithine
  SITE (2)..(2): Beta-Valine
  SITE (3)..(3): Beta-Serine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 20 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Serine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 21 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Serine
  SITE (10)..(10): Beta-Glutamic Acid
  SITE (11)..(11): Beta-Tyrosine
XXXXXXXXXXX

SEQ ID NO: 22 - protein, 11 aa, Artificial Sequence
  Synthetic Peptide
  SITE (1)..(1): Beta-Ornithine
  SITE (2)..(2): Beta-Valine
  SITE (3)..(3): Beta-Threonine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 23 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Threonine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 24 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Threonine
  SITE (10)..(10): Beta-Glutamic Acid
  SITE (11)..(11): Beta-Tyrosine
XXXXXXXXXXX

SEQ ID NO: 25 - protein, 11 aa, Artificial Sequence
  Synthetic Peptide
  SITE (1)..(1): Beta-Ornithine
  SITE (2)..(2): Beta-Valine
  SITE (3)..(3): Beta-Phenylalanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 26 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Phenylalanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 27 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Phenylalanine
  SITE (10)..(10): Beta-Glutamic Acid
  SITE (11)..(11): Beta-Tyrosine
XXXXXXXXXXX

SEQ ID NO: 28 - protein, 11 aa, Artificial Sequence
  Synthetic Peptide
  SITE (1)..(1): Beta-Ornithine
  SITE (2)..(2): Beta-Valine
  SITE (3)..(3): Beta-Tryptophan
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 29 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 30 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Tryptophan
  SITE (10)..(10): Beta-Glutamic Acid
  SITE (11)..(11): Beta-Tyrosine
XXXXXXXXXXX

SEQ ID NO: 31 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 32 - protein, 10 aa, Artificial Sequence
  Synthetic Peptide
  SITE (1)..(1): Beta-Ornithine
  SITE (2)..(2): Beta-Valine
  SITE (3)..(3): Beta-Phenylalanine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Leucine
  SITE (10)..(10): Beta-Glutamic Acid
XXXXXXXXXX

SEQ ID NO: 33 - protein, 10 aa, Artificial Sequence
  Synthetic Peptide
  SITE (1)..(1): Beta-Ornithine
  SITE (2)..(2): Beta-Leucine
  SITE (3)..(3): Beta-Valine
  SITE (4)..(4): Beta-Glutamic Acid
  SITE (5)..(5): Beta-Tryptophan
  SITE (6)..(6): Beta-Valine
  SITE (7)..(7): Beta-Ornithine
  SITE (8)..(8): Beta-Phenylalanine
  SITE (9)..(9): Beta-Valine
  SITE (10)..(10): Beta-Glutamic Acid
XXXXXXXXXX

SEQ ID NO: 34 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Valine
  SITE (4)..(4): Beta-Glutamic Acid
  SITE (5)..(5): Beta-Tryptophan
  SITE (6)..(6): Beta-Valine
  SITE (7)..(7): Beta-Ornithine
  SITE (8)..(8): Beta-Leucine
  SITE (9)..(9): Beta-Valine
  SITE (10)..(10): Beta-Glutamic Acid
XXXXXXXXXX

SEQ ID NO: 35 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 36 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 37 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 38 - protein, 10 aa, Artificial Sequence
  Synthetic Peptide
  SITE (1)..(1): Beta-Ornithine
  SITE (2)..(2): Beta-Valine
  SITE (3)..(3): Beta-Phenylalanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 39 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Phenylalanine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 40 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Leucine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 41 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Leucine
  SITE (10)..(10): Beta-Glutamic Acid
XXXXXXXXXX

SEQ ID NO: 42 - protein, 10 aa, Artificial Sequence
  Synthetic Peptide
  SITE (1)..(1): Beta-Ornithine
  SITE (2)..(2): Beta-Valine
  SITE (3)..(3): Beta-Isoleucine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 43 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Isoleucine
  SITE (7)..(7): Beta-Ornithine
  SITE (8)..(8): Beta-Valine
  SITE (9)..(9): Beta-Alanine
  SITE (10)..(10): Beta-Glutamic Acid
XXXXXXXXXX

SEQ ID NO: 44 - protein, 10 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Isoleucine
  SITE (10)..(10): Beta-Glutamic Acid
XXXXXXXXXX

SEQ ID NO: 45 - protein, 8 aa, Artificial Sequence
  Synthetic Peptide
  SITE (1)..(1): Beta-Leucine
  SITE (2)..(2): Beta-Glutamic Acid
  SITE (3)..(3): Beta-Valine
  SITE (4)..(4): Beta-Tryptophan
  SITE (5)..(5): Beta-Ornithine
  SITE (6)..(6): Beta-Valine
  SITE (7)..(7): Beta-Phenylalanine
  SITE (8)..(8): Beta-Glutamic Acid
XXXXXXXX

SEQ ID NO: 46 - protein, 6 aa, Artificial Sequence
  Synthetic Peptide
  SITE (1)..(1): Beta-Valine
  SITE (2)..(2): Beta-Tryptophan
  SITE (3)..(3): Beta-Ornithine
  SITE (4)..(4): Beta-Valine
  SITE (5)..(5): Beta-Phenylalanine
  SITE (6)..(6): Beta-Glutamic Acid
XXXXXX

SEQ ID NO: 47 - protein, 10 aa, Artificial Sequence
  Synthetic Peptide
  SITE (1)..(1): Beta-Ornithine
  SITE (2)..(2): Beta-Cysteine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 48 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Cysteine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 49 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Cysteine
  SITE (9)..(9): Beta-Phenylalanine
  SITE (10)..(10): Beta-Glutamic Acid
XXXXXXXXXX

SEQ ID NO: 50 - protein, 10 aa, Artificial Sequence
  Synthetic Peptide
  SITE (1)..(1): Beta-Ornithine
  SITE (2)..(2): Beta-Cysteine
  SITE (3)..(3): Beta-Leucine
  SITE (4)..(4): Beta-Glutamic Acid
  SITE (5)..(5): Beta-Cysteine
  SITE (6)..(6): Beta-Tryptophan
  SITE (7)..(7): Beta-Ornithine
  SITE (8)..(8): Beta-Cysteine
  SITE (9)..(9): Beta-Phenylalanine
  SITE (10)..(10): Beta-Glutamic Acid
XXXXXXXXXX

SEQ ID NO: 51 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Valine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 52 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Threonine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 53 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Isoleucine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 54 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Lysine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 55 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Glutamic Acid
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 56 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Phenylalanine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 57 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tyrosine
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 58 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 59 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXGXXGXX

SEQ ID NO: 60 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 61 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 62 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 63 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 64 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 65 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 66 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 67 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 68 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 69 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXGXXXXX

SEQ ID NO: 70 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 71 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXGXXXXX

SEQ ID NO: 72 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 73 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXGXXXXX

SEQ ID NO: 74 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 75 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXGXXXXX

SEQ ID NO: 76 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 77 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXGXXXXX

SEQ ID NO: 78 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 79 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXGXXXXX

SEQ ID NO: 80 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 81 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXGXXXXX

SEQ ID NO: 82 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 83 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXGXXXXX

SEQ ID NO: 84 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 85 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXGXXXXX

SEQ ID NO: 86 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XGXXXXXGXX

SEQ ID NO: 87 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 88 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 89 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 90 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 91 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 92 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 93 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 94 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 95 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 96 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 97 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 98 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 99 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 100 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 101 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 102 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XGXXXXXXXX

SEQ ID NO: 103 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 104 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 105 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 106 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 107 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 108 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 109 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 110 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 111 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 112 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 113 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 114 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 115 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 116 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XGXXXXXXXX

SEQ ID NO: 117 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 118 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 119 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 120 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 121 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 122 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 123 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 124 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 125 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 126 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 127 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 128 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XGXXXXXXXX

SEQ ID NO: 129 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 130 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 131 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 132 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 133 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 134 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 135 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 136 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 137 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 138 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XGXXXXXXXX

SEQ ID NO: 139 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 140 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 141 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 142 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 143 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 144 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 145 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 146 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XGXXXXXXXX

SEQ ID NO: 147 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 148 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 149 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 150 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 151 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 152 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XGXXXXXXXX

SEQ ID NO: 153 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 154 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 155 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 156 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XGXXXXXXXX

SEQ ID NO: 157 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XGXXXXXXXX

SEQ ID NO: 158 - protein, 10 aa, Artificial Sequence
  Synthetic Peptide
  SITE (1)..(1): Beta-Ornithine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XGXXXXXXXX

SEQ ID NO: 159 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 160 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 161 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 162 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 163 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 164 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 165 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 166 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 167 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 168 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 169 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 170 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 171 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 172 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 173 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 174 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 175 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 176 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 177 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 178 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 179 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 180 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 181 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 182 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 183 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 184 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 185 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 186 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 187 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 188 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 189 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 190 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 191 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 192 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 193 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 194 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 195 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 196 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 197 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 198 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 199 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 200 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 201 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 202 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 203 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 204 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 205 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 206 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 207 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 208 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 209 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 210 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 211 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 212 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 213 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 214 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 215 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 216 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 217 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 218 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 219 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 220 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 221 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 222 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 223 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 224 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 225 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 226 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 227 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 228 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 229 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 230 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 231 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 232 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 233 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 234 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 235 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 236 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 237 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 238 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 239 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 240 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 241 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 242 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 243 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 244 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 245 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 246 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 247 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 248 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 249 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 250 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 251 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 252 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 253 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 254 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 255 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 256 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 257 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 258 - protein, 10 aa, Artificial Sequence
  Synthetic Peptide
  SITE (1)..(1): Beta-Ornithine
  SITE (2)..(2): Beta-Alanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 259 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 260 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 261 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 262 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 263 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 264 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 265 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 266 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 267 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 268 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 269 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 270 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 271 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 272 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 273 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 274 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 275 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 276 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 277 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 278 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 279 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 280 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 281 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 282 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 283 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 284 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 285 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 286 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 287 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 288 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 289 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 290 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 291 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 292 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 293 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 294 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 295 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 296 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 297 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 298 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 299 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 300 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 301 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 302 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 303 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 304 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 305 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 306 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 307 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 308 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 309 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 310 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 311 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 312 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 313 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 314 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 315 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 316 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 317 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 318 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 319 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 320 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 321 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 322 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 323 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 324 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 325 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 326 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 327 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 328 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 329 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 330 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 331 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 332 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 333 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 334 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 335 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 336 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 337 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 338 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 339 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 340 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 341 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 342 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 343 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 344 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 345 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 346 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 347 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 348 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 349 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 350 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 351 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 352 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 353 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 354 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 355 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 356 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 357 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 358 - protein, 10 aa, Artificial Sequence
  Synthetic Peptide
  SITE (1)..(1): Beta-Ornithine
  SITE (2)..(2): Beta-Threonine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 359 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 360 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 361 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 362 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 363 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 364 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 365 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 366 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 367 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 368 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 369 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 370 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 371 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 372 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 373 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 374 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 375 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 376 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 377 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 378 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 379 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 380 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 381 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 382 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 383 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 384 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 385 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 386 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 387 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 388 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 389 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 390 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 391 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 392 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 393 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 394 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 395 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 396 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 397 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 398 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 399 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 400 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 401 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 402 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 403 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 404 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 405 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 406 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 407 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 408 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 409 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 410 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 411 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 412 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 413 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 414 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 415 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 416 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 417 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 418 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 419 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 420 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 421 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 422 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 423 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 424 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 425 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 426 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 427 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 428 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 429 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 430 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 431 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 432 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 433 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 434 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 435 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 436 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 437 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 438 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 439 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 440 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 441 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 442 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 443 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 444 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 445 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 446 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 447 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 448 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 449 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 450 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 451 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 452 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 453 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 454 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 455 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 456 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 457 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 458 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 459 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 460 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 461 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 462 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 463 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 464 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 465 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 466 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 467 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 468 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 469 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 470 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 471 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 472 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 473 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 474 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 475 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 476 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 477 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 478 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 479 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 480 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 481 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 482 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 483 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 484 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 485 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 486 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 487 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 488 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 489 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 490 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 491 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 492 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 493 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 494 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 495 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 496 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 497 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 498 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 499 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 500 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 501 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 502 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 503 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 504 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 505 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 506 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 507 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 508 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 509 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 510 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 511 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 512 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 513 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 514 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 515 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 516 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 517 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 518 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 519 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 520 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 521 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 522 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 523 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 524 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 525 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 526 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 527 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 528 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 529 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 530 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 531 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 532 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 533 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 534 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 535 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 536 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 537 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 538 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 539 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 540 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 541 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 542 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 543 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 544 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 545 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 546 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 547 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 548 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 549 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 550 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 551 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 552 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 553 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 554 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 555 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 556 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 557 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 558 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 559 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 560 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 561 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 562 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 563 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 564 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 565 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 566 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 567 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 568 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 569 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 570 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 571 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 572 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 573 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 574 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 575 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 576 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 577 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 578 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 579 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 580 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 581 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 582 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 583 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 584 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 585 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 586 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 587 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 588 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 589 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 590 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 591 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 592 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 593 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 594 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 595 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 596 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 597 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 598 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 599 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 600 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 601 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 602 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 603 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 604 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 605 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 606 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 607 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 608 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 609 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 610 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 611 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 612 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 613 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 614 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 615 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 616 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 617 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 618 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 619 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 620 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 621 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 622 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 623 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 624 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 625 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 626 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 627 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 628 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 629 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 630 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 631 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 632 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 633 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 634 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 635 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 636 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 637 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 638 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 639 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 640 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 641 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 642 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 643 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 644 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 645 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 646 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 647 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 648 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 649 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 650 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 651 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 652 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 653 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 654 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 655 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 656 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 657 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 658 - protein, 10 aa, Artificial Sequence
  Synthetic Peptide
  SITE (1)..(1): Beta-Ornithine
  SITE (2)..(2): Beta-Aspartic Acid
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 659 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 660 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 661 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 662 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 663 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 664 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 665 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 666 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 667 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 668 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 669 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 670 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 671 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 672 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 673 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 674 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 675 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 676 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 677 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 678 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 679 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 680 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 681 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 682 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 683 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 684 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 685 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 686 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 687 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 688 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 689 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 690 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 691 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 692 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 693 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 694 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 695 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 696 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 697 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 698 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 699 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 700 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 701 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 702 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 703 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 704 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 705 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 706 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 707 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 708 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 709 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 710 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 711 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 712 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 713 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 714 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 715 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 716 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 717 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 718 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 719 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 720 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 721 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 722 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 723 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 724 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 725 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 726 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 727 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 728 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 729 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 730 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 731 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 732 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 733 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 734 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 735 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 736 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 737 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 738 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 739 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 740 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 741 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 742 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 743 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 744 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 745 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 746 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 747 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 748 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 749 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 750 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 751 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 752 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 753 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 754 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 755 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 756 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 757 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 758 - protein, 10 aa, Artificial Sequence
  Synthetic Peptide
  SITE (1)..(1): Beta-Ornithine
  SITE (2)..(2): Beta-Lysine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 759 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 760 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 761 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 762 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 763 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 764 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 765 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 766 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 767 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 768 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 769 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 770 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 771 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 772 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 773 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 774 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 775 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 776 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 777 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 778 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 779 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 780 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 781 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 782 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 783 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 784 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 785 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 786 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 787 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 788 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 789 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 790 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 791 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 792 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 793 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 794 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 795 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 796 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 797 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 798 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 799 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 800 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 801 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 802 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 803 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 804 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 805 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 806 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 807 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 808 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 809 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 810 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 811 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 812 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 813 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 814 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 815 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 816 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 817 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 818 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 819 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 820 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 821 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 822 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 823 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 824 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 825 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 826 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 827 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 828 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 829 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 830 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 831 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 832 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 833 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 834 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 835 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 836 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 837 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 838 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 839 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 840 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 841 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 842 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 843 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 844 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 845 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 846 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 847 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 848 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 849 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 850 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 851 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 852 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 853 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 854 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 855 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 856 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 857 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 858 - protein, 10 aa, Artificial Sequence
  Synthetic Peptide
  SITE (1)..(1): Beta-Ornithine
  SITE (2)..(2): Beta-Phenylalanine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 859 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 860 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 861 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 862 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 863 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 864 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 865 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 866 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 867 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 868 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 869 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 870 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 871 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 872 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 873 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 874 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 875 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 876 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 877 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 878 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 879 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 880 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 881 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 882 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 883 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 884 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 885 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 886 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 887 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 888 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 889 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 890 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 891 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 892 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 893 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 894 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 895 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 896 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 897 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 898 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 899 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 900 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 901 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 902 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 903 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 904 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 905 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 906 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 907 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 908 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 909 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 910 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 911 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 912 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 913 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 914 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 915 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 916 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 917 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 918 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 919 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 920 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 921 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 922 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 923 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 924 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 925 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 926 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 927 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 928 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 929 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 930 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 931 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 932 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 933 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 934 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 935 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 936 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 937 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 938 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 939 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 940 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 941 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 942 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 943 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 944 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 945 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 946 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 947 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 948 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 949 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 950 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 951 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 952 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 953 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 954 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 955 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 956 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 957 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 958 - protein, 10 aa, Artificial Sequence
  Synthetic Peptide
  SITE (1)..(1): Beta-Ornithine
  SITE (2)..(2): Beta-Tyrosine
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 959 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXGXXGXX

SEQ ID NO: 960 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 961 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 962 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 963 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 964 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 965 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 966 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 967 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 968 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 969 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXGXXXXX

SEQ ID NO: 970 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 971 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXGXXXXX

SEQ ID NO: 972 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 973 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXGXXXXX

SEQ ID NO: 974 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 975 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXGXXXXX

SEQ ID NO: 976 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 977 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXGXXXXX

SEQ ID NO: 978 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 979 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXGXXXXX

SEQ ID NO: 980 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 981 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXGXXXXX

SEQ ID NO: 982 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 983 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXGXXXXX

SEQ ID NO: 984 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 985 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXGXXXXX

SEQ ID NO: 986 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (9)..(9): Beta-Phenylalanine
  SITE (10)..(10): Beta-Glutamic Acid
XXXXXXXGXX

SEQ ID NO: 987 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 988 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 989 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 990 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 991 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 992 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 993 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 994 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 995 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 996 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 997 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 998 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 999 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1000 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 1001 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Alanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1002 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Alanine
  SITE (9)..(9): Beta-Phenylalanine
  SITE (10)..(10): Beta-Glutamic Acid
XXXXXXXXXX

SEQ ID NO: 1003 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1004 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1005 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1006 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1007 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1008 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1009 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1010 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1011 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1012 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1013 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1014 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1015 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Threonine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1016 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Threonine
  SITE (9)..(9): Beta-Phenylalanine
  SITE (10)..(10): Beta-Glutamic Acid
XXXXXXXXXX

SEQ ID NO: 1017 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1018 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1019 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1020 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1021 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1022 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1023 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1024 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1025 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1026 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1027 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1028 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Glutamic Acid
XXXXXXXXXX

SEQ ID NO: 1029 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1030 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1031 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1032 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1033 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1034 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1035 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1036 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1037 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Isoleucine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1038 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Isoleucine
  SITE (9)..(9): Beta-Phenylalanine
  SITE (10)..(10): Beta-Glutamic Acid
XXXXXXXXXX

SEQ ID NO: 1039 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1040 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1041 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1042 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1043 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1044 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1045 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Aspartic Acid
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1046 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Aspartic Acid
  SITE (9)..(9): Beta-Phenylalanine
  SITE (10)..(10): Beta-Glutamic Acid
XXXXXXXXXX

SEQ ID NO: 1047 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1048 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1049 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1050 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1051 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Lysine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1052 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Lysine
  SITE (9)..(9): Beta-Phenylalanine
  SITE (10)..(10): Beta-Glutamic Acid
XXXXXXXXXX

SEQ ID NO: 1053 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1054 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1055 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Phenylalanine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1056 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Phenylalanine
  SITE (9)..(9): Beta-Phenylalanine
  SITE (10)..(10): Beta-Glutamic Acid
XXXXXXXXXX

SEQ ID NO: 1057 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tyrosine
  SITE (6)..(6): Beta-Tryptophan
  SITE (7)..(7): Beta-Ornithine
  SITE (8)..(8): Beta-Tryptophan
  SITE (9)..(9): Beta-Phenylalanine
  SITE (10)..(10): Beta-Glutamic Acid
XXXXXXXXXX

SEQ ID NO: 1058 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Leucine
  SITE (4)..(4): Beta-Glutamic Acid
  SITE (5)..(5): Beta-Tryptophan
  SITE (6)..(6): Beta-Tryptophan
  SITE (7)..(7): Beta-Ornithine
  SITE (8)..(8): Beta-Tyrosine
  SITE (9)..(9): Beta-Phenylalanine
  SITE (10)..(10): Beta-Glutamic Acid
XXXXXXXXXX

SEQ ID NO: 1059 - protein, 12 aa, Artificial Sequence
  Synthetic Peptide
  SITE (1)..(1): Beta-Cysteine
  SITE (2)..(2): Beta-Valine
  SITE (3)..(3): Beta-Alanine
  SITE (4)..(4): Beta-Aspartic Acid
  SITE (5)..(5): Beta-Valine
  SITE (6)..(6): Beta-Alanine
  SITE (7)..(7): Beta-Cysteine
  SITE (8)..(8): Beta-Valine
  SITE (9)..(9): Beta-Alanine
  SITE (10)..(10): Beta-Aspartic Acid
  SITE (11)..(11): Beta-Tyrosine
  SITE (12)..(12): Beta-Cysteine
XXXXXXXXXXXX

SEQ ID NO: 1060 - protein, 11 aa, Artificial Sequence
  Synthetic Peptide
  SITE (1)..(1): Beta-Ornithine
  SITE (2)..(2): Beta-Valine
  SITE (3)..(3): Beta-Alanine
  SITE (4)..(4): Beta-Aspartic Acid
  SITE (5)..(5): Beta-Valine
  SITE (6)..(6): Beta-Alanine
  SITE (7)..(7): Beta-Ornithine
  SITE (8)..(8): Beta-Valine
  SITE (9)..(9): Beta-Alanine
  SITE (10)..(10): Beta-Aspartic Acid
  SITE (11)..(11): Beta-Tyrosine
XXXXXXXXXXX

SEQ ID NO: 1061 - protein, 11 aa, Artificial Sequence
  Synthetic Peptide
  SITE (1)..(1): Beta-Cysteine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Cysteine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 1062 - protein, 11 aa, Artificial Sequence
  Synthetic Peptide
  SITE (1)..(1): Beta-Lysine
  SITE (2)..(2): Beta-Valine
  SITE (3)..(3): Beta-Alanine
  SITE (4)..(4): Beta-Aspartic Acid
  SITE (5)..(5): Beta-Valine
  SITE (6)..(6): Beta-Alanine
  SITE (7)..(7): Beta-Lysine
  SITE (8)..(8): Beta-Valine
  SITE (9)..(9): Beta-Alanine
  SITE (10)..(10): Beta-Aspartic Acid
  SITE (11)..(11): Beta-Tyrosine
XXXXXXXXXXX

SEQ ID NO: 1063 - protein, 11 aa, Artificial Sequence
  Synthetic Peptide
  SITE (1)..(1): Beta-Lysine
  SITE (2)..(2): Beta-Valine
  SITE (3)..(3): Beta-Alanine
  SITE (4)..(4): Beta-Glutamic Acid
  SITE (5)..(5): Beta-Valine
  SITE (6)..(6): Beta-Alanine
  SITE (7)..(7): Beta-Lysine
  SITE (8)..(8): Beta-Valine
  SITE (9)..(9): Beta-Alanine
  SITE (10)..(10): Beta-Glutamic Acid
  SITE (11)..(11): Beta-Tyrosine
XXXXXXXXXXX

SEQ ID NO: 1064 - protein, 10 aa, Artificial Sequence
  Synthetic Peptide
  SITE (1)..(1): Beta-Ornithine
  SITE (2)..(2): Beta-Valine
  SITE (3)..(3): Beta-Leucine
  SITE (4)..(4): Beta-Aspartic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Phenylalanine
  SITE (10)..(10): Beta-Aspartic Acid
XXXXXXXXXX

SEQ ID NO: 1065 - protein, 10 aa, Artificial Sequence
  Synthetic Peptide
  SITE (1)..(1): Beta-Ornithine
  SITE (2)..(2): Beta-Valine
  SITE (3)..(3): Beta-Isoleucine
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Tryptophan
  SITE (10)..(10): Beta-Glutamic Acid
XXXXXXXXXX

SEQ ID NO: 1066 - protein, 10 aa, Artificial Sequence
  Synthetic Peptide
  SITE (1)..(1): Beta-Ornithine
  SITE (2)..(2): Beta-Isoleucine
  SITE (3)..(3): Beta-Valine
  SITE (4)..(4): Beta-Glutamic Acid
  SITE (5)..(5): Beta-Tryptophan
  SITE (6)..(6): Beta-Valine
  SITE (7)..(7): Beta-Ornithine
  SITE (8)..(8): Beta-Tryptophan
  SITE (9)..(9): Beta-Valine
  SITE (10)..(10): Beta-Glutamic Acid
XXXXXXXXXX

SEQ ID NO: 1067 - protein, 10 aa, Artificial Sequence
  Synthetic Peptide
  SITE (1)..(1): Beta-Ornithine
  SITE (2)..(2): Beta-Tryptophan
  SITE (3)..(3): Beta-Valine
  SITE (4)..(4): Beta-Glutamic Acid
  SITE (5)..(5): Beta-Tryptophan
  SITE (6)..(6): Beta-Valine
  SITE (7)..(7): Beta-Ornithine
  SITE (8)..(8): Beta-Isoleucine
  SITE (9)..(9): Beta-Valine
  SITE (10)..(10): Beta-Glutamic Acid
XXXXXXXXXX

SEQ ID NO: 1068 - protein, 10 aa, Artificial Sequence
  Synthetic Peptide
  SITE (1)..(1): Beta-Ornithine
  SITE (2)..(2): Beta-Valine
  SITE (3)..(3): Beta-Tryptophan
  SITE (4)..(4): Beta-Glutamic Acid
  SITE (5)..(5): Beta-Valine
  SITE (6)..(6): Beta-Tryptophan
  SITE (7)..(7): Beta-Ornithine
  SITE (8)..(8): Beta-Valine
  SITE (9)..(9): Beta-Isoleucine
  SITE (10)..(10): Beta-Glutamic Acid
XXXXXXXXXX

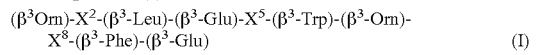

We claim:

1. An isolated β-peptide, wherein the isolated β-peptide comprises:

(a) the sequence (I):

(β$^3$Orn)-X$^2$-(β$^3$-Leu)-(β$^3$-Glu)-X$^5$-(β$^3$-Trp)-(β$^3$-Orn)-X$^8$-(β$^3$-Phe)-(β$^3$-Glu)    (I)

wherein each X$^2$, X$^5$ or X$^8$ are independently selected from the group consisting of α-Gly, β$^3$-Ala, β$^3$-Asp, β$^3$-Ile, β$^3$-Lys, β$^3$-Phe, β$^3$-Thr, β$^3$-Trp, β$^3$-Tyr and β$^3$-Val, or (b) the isolated β-peptide of sequence (I) wherein one β-amino acid is replaced by another β-amino acid.

2. The isolated β-peptide of claim 1, wherein the isolated β-peptide is selected from the group consisting of:
(a) compounds 56-1055 (SEQ ID NOS: 59-1058) and
(b) a β-peptide having one β-amino acid substitution in any one of compounds 56-1055 (SEQ ID NOS: 59-1058).

3. The isolated β-peptide of claim 1, wherein the isolated β-peptide comprises SEQ ID NO: 460.

4. The isolated β-peptide of claim 1, wherein the isolated β-peptide comprises a sequence that has one β-amino acid substitution relative to SEQ ID NO: 460.